US009193780B2

(12) United States Patent
Hultberg et al.

(10) Patent No.: US 9,193,780 B2
(45) Date of Patent: Nov. 24, 2015

(54) AMINO ACID SEQUENCES DIRECTED AGAINST ENVELOPE PROTEINS OF A VIRUS AND POLYPEPTIDES COMPRISING THE SAME FOR THE TREATMENT OF VIRAL DISEASES

(75) Inventors: Anna Hultberg, Vleuten (NL); Bram Maassen, De Bilt (NL); Peter Vanlandschoot, Bellem (BE); Erik Depla, Destelbergen (BE); Catelijne Stortelers, Ghent (BE); Cornelis Theodorus Verrips, Besse sur Issole (FR); Steven Van Gucht, Denderleeuw (BE); Jose Melero, Madrid (ES); Michael John Scott Saunders, Brussels (BE); Johannes Joseph Wilhelmus De Haard, Oudelande (NL); Robert Anthony Weiss, London (GB); Nigel J. Temperton, Tonbridge (GB); Xavier Saelens, Ypres (BE); Bert Schepens, Drongen (BE); Alexander Szyroki, Ghent (BE); Michael Marie Harmsen, AM Weesp (NL)

(73) Assignee: Ablynx N.V., Zwijnaarde (BE)

( * ) Notice: Subject to any disclaimer, the term of this patent is extended or adjusted under 35 U.S.C. 154(b) by 1310 days.

(21) Appl. No.: 12/996,074

(22) PCT Filed: Jun. 5, 2009

(86) PCT No.: PCT/EP2009/056975

§ 371 (c)(1),
(2), (4) Date: Mar. 17, 2011

(87) PCT Pub. No.: WO2009/147248

PCT Pub. Date: Dec. 10, 2009

(65) Prior Publication Data

US 2011/0182897 A1 Jul. 28, 2011

Related U.S. Application Data

(60) Provisional application No. 61/059,055, filed on Jun. 5, 2008, provisional application No. 61/092,991, filed on Aug. 29, 2008, provisional application No. 61/139,130, filed on Dec. 19, 2008, provisional application No. 61/144,653, filed on Jan. 14, 2009, provisional application No. 61/172,914, filed on Apr. 27, 2009, provisional application No. 61/174,108, filed on Apr. 30, 2009.

(51) Int. Cl.

| | |
|---|---|
| ***A61K 39/395*** | (2006.01) |
| ***C07K 2/00*** | (2006.01) |
| ***C07K 14/00*** | (2006.01) |
| ***C07K 16/00*** | (2006.01) |
| ***C07H 21/00*** | (2006.01) |
| ***C12N 5/10*** | (2006.01) |
| ***A61K 38/16*** | (2006.01) |
| ***C12P 21/02*** | (2006.01) |
| ***A61P 31/12*** | (2006.01) |
| ***A61P 37/02*** | (2006.01) |
| ***C07K 16/10*** | (2006.01) |
| *A61K 39/00* | (2006.01) |

(52) U.S. Cl.
CPC ............ *C07K 16/10* (2013.01); *C07K 16/1009* (2013.01); *C07K 16/1018* (2013.01); *C07K 16/1027* (2013.01); *A61K 2039/505* (2013.01); *A61K 2039/507* (2013.01); *C07K 2316/96* (2013.01); *C07K 2317/22* (2013.01); *C07K 2317/24* (2013.01); *C07K 2317/55* (2013.01); *C07K 2317/565* (2013.01); *C07K 2317/569* (2013.01); *C07K 2317/92* (2013.01); *C07K 2319/00* (2013.01)

(58) Field of Classification Search
None
See application file for complete search history.

(56) References Cited

U.S. PATENT DOCUMENTS

| | | | | |
|---|---|---|---|---|
| 6,818,216 | B2 * | 11/2004 | Young et al. | 424/159.1 |
| 2006/0013824 | A1 | 1/2006 | Scallon | |
| 2006/0083683 | A1 * | 4/2006 | Hsei et al. | 424/1.49 |
| 2008/0085277 | A1 | 4/2008 | Cho et al. | |
| 2011/0182897 | A1 * | 7/2011 | Hultberg et al. | 424/134.1 |
| 2012/0128669 | A1 | 5/2012 | Depla et al. | |
| 2012/0301469 | A1 | 11/2012 | Depla et al. | |

FOREIGN PATENT DOCUMENTS

| | | | |
|---|---|---|---|
| EP | 2 096 121 | A1 | 9/2009 |
| WO | WO 96/40252 | A1 | 12/1996 |
| WO | WO 98/19704 | A1 | 5/1998 |
| WO | WO 00/65057 | A1 | 11/2000 |
| WO | WO 00/69462 | A1 | 11/2000 |
| WO | WO 03/051912 | A2 | 6/2003 |
| WO | WO 03/105894 | A1 | 12/2003 |
| WO | WO 2004/003019 | A2 | 1/2004 |
| WO | WO 2005/079479 | A2 | 9/2005 |
| WO | WO 2006/034292 | A2 | 3/2006 |

(Continued)

OTHER PUBLICATIONS

Vincke et al. (Journal of Biological Chemistry. 2009; 284: 3273-3284).*
Deschacht et al. (Journal of Immunology. 2010; 184: 5696-5704).*
Rudikoff et al. (PNAS. 1982; 79: 1979-1983.*
Kashmiri et al. (Methods. 2005; 36:25-34).*

(Continued)

*Primary Examiner* — Shanon A Foley
(74) *Attorney, Agent, or Firm* — Wolf, Greenfield & Sacks, P.C.

(57) ABSTRACT

The present invention relates in part to amino acid sequences that are directed against and/or that can specifically bind to an envelope protein of a virus, as well as to compounds or constructs, and in particular proteins and polypeptides, that comprise or essentially consist of one or more such amino acid sequences.

19 Claims, 105 Drawing Sheets

(56) References Cited

FOREIGN PATENT DOCUMENTS

| | | | |
|---|---|---|---|
| WO | WO 2006/040153 | A2 | 4/2006 |
| WO | WO 2006/050166 | A2 | 5/2006 |
| WO | WO 2006/050280 | A2 | 5/2006 |
| WO | WO 2006/107617 | A2 | 10/2006 |
| WO | WO 2008/077945 | A2 | 7/2008 |
| WO | WO 2009/147248 | A2 | 12/2009 |
| WO | WO 2010/081856 | A1 | 7/2010 |
| WO | WO 2010/139808 | A2 | 12/2010 |

OTHER PUBLICATIONS

Tamura et al. (Journal of Immunology. 2000; 164 (3):1432-1441).*

Greenspan et al (Nature Biotechnology 17:936-937 (1999)).*

Harmsen et al. (Veterinary Microbiology. 2007; 120: 193-206).*

Haynes (Journal of Infectious Diseases. 2013; 208 (S3): S177-83).*

Johnson et al. (Journal of Infectious Diseases. 1999; 180: 35-40).*

Baker et al., Structural basis for paramyxovirus-mediated membrane fusion. Mol Cell. Mar. 1999;3(3):309-19.

Barbas et al., Human monoclonal Fab fragments derived from a combinatorial library bind to respiratory syncytial virus F glycoprotein and neutralize infectivity. Proc Natl Acad Sci U S A. Nov. 1, 1992;89(21):10164-8.

Burioni et al., Recombinant human Fab to glycoprotein D neutralizes infectivity and prevents cell-to-cell transmission of herpes simplex viruses 1 and 2 in vitro. Proc Natl Acad Sci U S A. Jan. 4, 1994;91(1):355-9.

Chen et al., N- and C-terminal residues combine in the fusion-pH influenza hemagglutinin HA2 subunit to form an N cap that terminates the triple-stranded coiled coil. Proc Natl Acad Sci U S A. Aug. 3, 1999;96(16):8967-72.

Crowe et al., Recombinant human respiratory syncytial virus (RSV) monoclonal antibody Fab is effective therapeutically when introduced directly into the lungs of RSV-infected mice. Proc Natl Acad Sci U S A. Feb. 15, 1994;91(4):1386-90.

Dekker et al., Intracellularly expressed single-domain antibody against p15 matrix protein prevents the production of porcine retroviruses. J Virol. Nov. 2003;77(22):12132-9.

Earp et al., The many mechanisms of viral membrane fusion proteins. Curr Top Microbiol Immunol. 2005;285:25-66.

Fiers et al., A "universal" human influenza A vaccine. Virus Res. Jul. 2004;103(1-2):173-6.

Forsman et al., Neutralising llama antibody fragments as HIV-1 entry inhibitors, EU-WHO Neut workshop. Italy. Mar. 2007. Abstract.

Fujinami et al., Antiviral antibody reacting on the plasma membrane alters measles virus expression inside the cell. Nature. Jun. 7, 1979;279(5713):529-30.

Gerhard, The role of the antibody response in influenza virus infection. Curr Top Microbiol Immunol. 2001;260:171-90.

Goldman et al, Facile generation of heat-stable antiviral and antitoxin single domain antibodies from a semisynthetic llama library. Anal Chem. Dec. 15, 2006;78(24):8245-55.

Hanson et al., Passive immunoprophylaxis and therapy with humanized monoclonal antibody specific for influenza A H5 hemagglutinin in mice. Respir Res. Oct. 14, 2006;7:126.

Heldwein et al., Crystal structure of glycoprotein B from herpes simplex virus 1. Science. Jul. 14, 2006;313(5784):217-20.

Helenius et al., On the entry of Semliki forest virus into BHK-21 cells. J Cell Biol. Feb. 1980;84(2):404-20.

Lamarre et al., Protection from lethal coronavirus infection by immunoglobulin fragments. J Immunol. Apr. 15, 1995;154(8):3975-84.

Lescar et al., The Fusion glycoprotein shell of Semliki Forest virus: an icosahedral assembly primed for fusogenic activation at endosomal pH. Cell. Apr. 6, 2001;105(1):137-48.

Levine et al., Antibody-mediated clearance of alphavirus infection from neurons. Science. Nov. 8, 1991;254(5033):856-60.

Lu et al., Passive immunotherapy for influenza A H5N1 virus infection with equine hyperimmune globulin F(ab')2 in mice. Respir Res. Mar. 23, 2006;7:43.

Mason et al., Cloning and expression of a single-chain antibody fragment specific for foot-and-mouth disease virus. Virology. Oct. 15, 1996;224(2):548-54.

Modis et al., A ligand-binding pocket in the dengue virus envelope glycoprotein. Proc Natl Acad Sci U S A. Jun. 10, 2003;100(12):6986-91. Epub May 20, 2003.

Moore et al., The entry of entry inhibitors: a fusion of science and medicine. Proc Natl Acad Sci U S A. Sep. 16, 2003;100(19):10598-602. Epub Sep. 5, 2003.

Palladino et al., Virus-neutralizing antibodies of immunoglobulin G (IgG) but not of IgM or IgA isotypes can cure influenza virus pneumonia in SCID mice. J Virol. Apr. 1995;69(4):2075-81.

Pantaleo et al., Effect of anti-V3 antibodies on cell-free and cell-to-cell human immunodeficiency virus transmission. Eur J Immunol. Jan. 1995;25(1):226-31.

Prince et al., Mechanism of antibody-mediated viral clearance in immunotherapy of respiratory syncytial virus infection of cotton rats. J Virol. Jun. 1990;64(6):3091-2.

Renegar et al., Role of IgA versus IgG in the control of influenza viral infection in the murine respiratory tract. J Immunol. Aug. 1, 2004;173(3):1978-86.

Rey et al., The envelope glycoprotein from tick-borne encephalitis virus at 2 Angstrom resolution. Nature. May 25, 1995;375(6529):291-8.

Roche et al., Crystal structure of the low-pH form of the vesicular stomatitis virus glycoprotein G. Science. Jul. 14, 2006;313(5784):187-91. Erratum in: Science. Sep. 8, 2006;313(5792):1389.

Sawyer, Antibodies for the prevention and treatment of viral diseases. Antiviral Res. Aug. 2000;47(2):57-77.

Schofield et al., Variations in the neutralizing and haemagglutination-inhibiting activities of five influenza A virus-specific IgGs and their antibody fragments. J Gen Virol. Oct. 1997;78 (Pt 10):2431-9.

Serruys et al., In vitro inhibition of HBsAg secretion by single-domain intrabodies. 12th International Symposium on Viral Hepatitis and Liver Disease. 2006. Abstract P.026. p. S69.

Sherwood et al., Rapid assembly of sensitive antigen-capture assays for Marburg virus, using in vitro selection of llama single-domain antibodies, at biosafety level 4. J Infect Dis. Nov. 15, 2007;196 Suppl 2:S213-9.

Sieczkarski et al., Viral entry. Curr Top Microbiol Immunol. 2005;285:1-23.

Skehel et al., Coiled coils in both intracellular vesicle and viral membrane fusion. Cell. Dec. 23, 1998;95(7):871-4.

Smirnov et al., Prevention and treatment of bronchopneumonia in mice caused by mouse-adapted variant of avian H5N2 influenza A virus using monoclonal antibody against conserved epitope in the HA stem region. Arch Virol. 2000;145(8):1733-41.

Smith et al., How viruses enter animal cells. Science. Apr. 9, 2004;304(5668):237-42.

Thullier et al., A recombinant Fab neutralizes dengue virus in vitro. J Biotechnol. Apr. 15, 1999;69(2-3):183-90.

Wilson et al., Structure of the haemagglutinin membrane glycoprotein of influenza virus at 3 Angstrom resolution. Nature. Jan. 29, 1981;289(5796):366-73.

Yin et al., Structure of the uncleaved ectodomain of the paramyxovirus (hPIV3) fusion protein. Proc Natl Acad Sci U S A. Jun. 28, 2005;102(26):9288-93. Epub Jun. 17, 2005.

[No Author Listed], Rabies Antibody Combination. Crucell. http://www.crucell.com/R_and_D-Clinical_Development-Rabies_Antibody_Product. Last Accessed on Dec. 16, 2010. 2 pages.

[No Author Listed], Rabies Monoclonal Antibody Cocktail. Crucell. http://www.crucell.com/R_and_D-Clinical_Development-Rabies_Antibody_Product. Last Accessed on Oct. 30, 2008. 2 pages.

[No Author Listed], Rabies. WHO Fact Sheet No. 99. World Heath Organization. Sep. 2006. http://www.who.int/mediacentre/factsheets/fs099/en/print.html. Last Accessed on Oct. 30, 2008. 3 pages.

[No Author Listed], Rabies. WHO Fact Sheet No. 99. World Heath Organization. Updated Sep. 2010. http://www.who.int/mediacentre/factsheets/fs099/en/index.html. Last Accessed on Dec. 16, 2010. 4 pages.

(56) References Cited

OTHER PUBLICATIONS

Awasthi et al., Imaging findings in rabies encephalitis. AJNR Am J Neuroradiol. Apr. 2001;22(4):677-80.
Cardoso et al., Nanobodies® with in vitro neutralizing activity protect mice against H5N1 influenza virus infection. Antivirals Congress, Amsterdam, The Netherlands. Nov. 7-9, 2010. Meeting Abstract. 2 pages.
Corral et al., High level expression of soluble glycoproteins in the allantoic fluid of embryonated chicken eggs using a Sendai virus minigenome system. BMC Biotechnol. Apr. 5, 2007;7:17. 9 pages.
De Haard et al., Llama antibodies against a lactococcal protein located at the tip of the phage tail prevent phage infection. J Bacteriol. Jul. 2005;187(13):4531-41.
Depla et al., Generation and characterization of ultra-potent RSV neutralising Nanobodies. 7$^{th}$ International Respiratory Syncytial Virus Symposium. Rotterdam, The Netherlands. Dec. 2-5, 2010. Presentation Abstract. 2 pages. Final Programme p. 162.
Depla et al., Prophylactic and therapeutic efficacy of anti-RSV Nanobody in a cotton rat challenge model. 7$^{th}$ International Respiratory Syncytial Virus Symposium. Rotterdam, The Netherlands. Dec. 2-5, 2010. Poster Abstract. 2 pages. Final Programme p. 169.
Detalle et al., Assessment of in vivo and in vitro efficacy of an anti-RSV Nanobody®: superior potency over palivizumab and prophylactic effect after pulmonary administration. 1$^{st}$ Symposium on Single Domain Antibodies. Ghent, Belgium. Oct. 14-15, 2010. Meeting Abstract p. 12.
Dietzschold et al., Differences in cell-to-cell spread of pathogenic and apathogenic rabies virus in vivo and in vitro. J Virol. Oct. 1985;56(1):12-8.
Dimitrov, Cell biology of virus entry. Cell. Jun. 23, 2000;101(7):697-702.
Harmsen et al., Passive immunization of pigs with bispecific llama single-domain antibody fragments against foot-and-mouth disease and porcine immunoglobulin. Vet Microbiol. (2008), doi:10.1016/j.vetmic.2008.04.30.
Holliger et al., Engineered antibody fragments and the rise of single domains. Nat Biotechnol. Sep. 2005;23(9):1126-36. Review.
Hultberg et al., Lactobacillli expressing llama VHH fragments neutralise *Lactococcus* phages. BMC Biotechnol. Sep. 17, 2007;7:58.
Hultberg et al., Llama-derived immunoglobulin single variable domains to build multivalent superpotent and broadened neutralizing anti-viral molecules. XIV International Conference on Negative Stand Viruses. Brugge, Belgium. Jun. 20-25, 2010. Abstract No. 345.
Ibanez et al., Nanobodies® with in vitro neutralizing activity protect mice against H5N1 influenza virus infection. XIV International Conference on Negative Strand Viruses. Brugge, Belgium. Jun. 20-25, 2010. Abstract 307.
Ibanez et al., Single domain antibodies with in vitro and in vivo neutralizing activity protect mice against H5N1influenza virus infection. 1$^{st}$ Symposium on Single Domain Antibodies. Ghent, Belgium. Oct. 14-15, 2010. Meeting Abstract p. 19.
Ibanez et al., Single-domain antibodies with in vitro and in vivo neutralizing activity protect mice against H5N1 influenza virus infection. Options for the Control of Influenza VII. Abstract Book. Hong Kong SAR, China. Sep. 3-7, 2010. Abstract p. 174.
Jain et al., Engineering antibodies for clinical applications. Trends Biotechnol. Jul. 2007;25(7):307-16. Review.
Kielian et al., Virus membrane-fusion proteins: more than one way to make a hairpin. Nat Rev Microbiol. Jan. 2006;4(1):67-76. Review.
Kielian, Class II virus membrane fusion proteins. Virology. Jan. 5, 2006;344(1):38-47.
Kodama et al., Specific and effective targeting cancer immunotherapy with a combination of three bispecific antibodies. Immunol Lett. Apr. 22, 2002;81(2):99-106.
Ledeboer et al., Preventing phage lysis of *Lactococcus lactis* in cheese production using a neutralizing heavy-chain antibody fragment from llama. J Dairy Sci. Jun. 2002;85(6):1376-82.
Montano-Hirose et al., Protective activity of a murine monoclonal antibody against European bat lyssavirus 1 (EBL1) infection in mice. Vaccine. Sep. 1993;11(12):1259-66.
Murphy et al., Current approaches to the development of vaccines effective against parainfluenza and respiratory syncytial viruses. Virus Res. Aug. 1988;11(1):1-15. Review.
Ogra, Respiratory syncytial virus: the virus, the disease and the immune response. Paediatr Respir Rev. 2004;5 Suppl A:S119-26. Review.
Okuno et al., A common neutralizing epitope conserved between the hemagglutinins of influenza A virus H1 and H2 strains. J Virol. May 1993;67(5):2552-8.
Rosseels et al., Prophylactic treatment with anti-rabies Nanobodies® can protect mice from lethal rabies virus challenge. XIV International Conference on Negative Strand Viruses. Brugge, Belgium. Jun. 20-25, 2010. Abstract 301.
Rosseels et al., VHH selected against the viral spike protein can protect mice against lethal rabies virus challenge. Annual Scientific Meeting of the Institute Pasteur International Network. Hong Kong. Nov. 22-23, 2010. Abstract p. 025.
Rosseels et al., VHH-based Nanobodies® selected against the viral spike protein can protect mice against lethal rabies virus challenge. WIV-ISP Scientific Report. 2008-2009. pp. 92-95.
Schepens et al., Nanobodies® protect mice against human respiratory syncytial virus infection. XIV International Conference on Negative Strand Viruses. Brugge, Belgium. Jun. 20-25, 2010. Abstract 318.
Schepens et al., Nanobodies® protect mice against human respiratory syncytial virus infection by inhibiting viral fusion.7$^{th}$ International Respiratory Syncytial Virus Symposium. Rotterdam, The Netherlands. Dec. 2-5, 2010. Presentation Abstract. Final Programme p. 178.
Schepens et al., Nanobodies® protect mice against human respiratory syncytial virus infection by inhibiting viral fusion. 1$^{st}$ Symposium on Single Domain Antibodies. Ghent, Belgium. Oct. 14-15, 2010. Meeting Abstract.
Schumacher et al., Inhibition of immune responses against rabies virus by monoclonal antibodies directed against rabies virus antigens. Vaccine. 1992;10(11):754-60.
Souriau et al., Recombinant antibodies for cancer diagnosis and therapy. Expert Opin Biol Ther. Apr. 2003;3(2):305-18. Review.
Spinelli et al., Lactococcal bacteriophage p2 receptor-binding protein structure suggests a common ancestor gene with bacterial and mammalian viruses. Nat Struct Mol Biol. Jan. 2006;13(1):85-9.
Spinelli et al., The crystal structure of a llama heavy chain variable domain. Nat Struct Biol. Sep. 1996;3(9):752-7.
Subbarao et al., Scientific barriers to developing vaccines against avian influenza viruses. Nat Rev Immunol. Apr. 2007;7(4):267-78. Review.
Tremblay et al., Receptor-binding protein of *Lactococcus lactis* phages: identification and characterization of the saccharide receptor-binding site. J Bacteriol. Apr. 2006;188(7):2400-10.
Verschueren, Design of experiments in the framework of a cell based potency assay. BEBPA's 3$^{rd}$ Annual biological Assay Conference. Pre-Conference Workshop: Practical Tools for the Bioassay Scientist. Barcelona, Spain. Sep. 29-Oct. 1, 2010. 9:30am-10:15am. Abstract.
Weissenhorn et al., Virus membrane fusion. FEBS Lett. May 22, 2007;581(11):2150-5. Epub Feb. 16, 2007. Review.
Woldehiwet, Rabies: recent developments. Res Vet Sci. Aug. 2002;73(1):17-25. Review.
Wright et al., The efficacy of current rabies vaccines and novel Nanobody®-based antivirals against highly pathogenic phylogroup-1 and-2 members of the *Lyssavirus* genus. XXI International meeting on Rabies in the Americas (RITA XXI). Guadalajara, Jal. Oct. 17-22, 2010.
Wright et al., The efficacy of current vaccines and novel nanobody-based antivirals against highly pathogenic rabies and lyssaviruses. SGM Spring 2010 Meeting. Edinburgh International Conference Centre. Edinburgh, UK. Mar. 29-Apr. 1, 2010. Abstract. p. 81-82.

(56) References Cited

OTHER PUBLICATIONS

[No Author Listed] Alexion Pharmaceuticals™ Antibody Therapy Shown Effective in Model for Severe Allergic Asthma. Last accessed at http://www.alxn.com/news/article.aspx?relid=216307 on Aug. 14, 2012.
Abarca et al., Safety, Tolerability, Pharmacokinetics, and Immunogenicity of Motavizumab, a Humanized, Enhanced-Potency Monoclonal Antibody for the Prevention of Respiratory Syncytial Virus Infection in At-Risk Children. Pediat Infect Dis J. 2009;28(4):267-72.
Arbiza et al., Characterization of two antigenic sites recognized by neutralizing monoclonal antibodies directed against the fusion glycoprotein of human respiratory syncytial virus. J Gen Virol. 1992;73:2225-34.
Delagrave et al., Effects of humanization by variable domain resurfacing on the antiviral activity of a single-chain antibody against respiratory syncytial virus. Protein Eng. Apr. 1999;12(4):357-62.
Deyev et al., Multivalency: the hallmark of antibodies used for optimization of tumor targeting by design. BioEssays. 2008;30(9):904-18.
Harmsen et al., Properties, production, and applications of camelid single-domain antibody fragments. Appl Microbiol Biotechnol. Nov. 2007;77(1):13-22. Epub Aug. 18, 2007.
Hultberg et al., Llama-derived single domain antibodies to build multivalent, superpotent and broadened neutralizing anti-viral molecules. PLoS One. Apr. 1, 2011;6(4):e17665. doi: 10.1371/journal.pone.0017665.
Monegal, et al., Immunological applications of single-domain llama recombinant antibodies isolated from a naïve library. Prot Eng Des Sel. 2009;22(4):273-80.
Morton et al., Structural characterization of respiratory syncytial virus fusion inhibitor escape mutants: homology model of the F protein and a syncytium formation assay. Virol. 2003;311:275-88.
Nguyen et al., Efficient generation of respiratory syncytial virus (RSV)-neutralizing human MoAbs via human peripheral blood lymphocyte (hu-PBL)-SCID mice and scFv phage display libraries. Clin Exp Immunol. Oct. 2000;122(1):85-93.
Wu et al., Development of Motavizumab, an Ultra-potent Antibody for the Prevention of Respiratory Syuncytial Virus Infection in the Upper and Lower Respiratory Tract. J Mol Biol. 2007;368:652-65.
Wu et al., Immunoprophylaxis of RSV Infection: Advancing from RSV-IGIV to Palivizumab and Motavizumab. Curr Top Microbiol Immunol. 2008;317:103-23.
[No Author Listed] Domain antibodies. http://www.domantis.com/domain.htm. Accessed on Oct. 28, 2009.
Gómez-Sebastián et al., Rotavirus A-specific single-domain antibodies produced in baculovirus-infected insect larvae are protective in vivo. BMC Biotechnol. Sep. 7, 2012;12:59.
Houdebine, Production of pharmaceutical proteins by transgenic animals. Comp Immunol Microbiol Infect Dis. Mar. 2009;32(2):107-21. doi: 10.1016/j.cimid.2007.11.005. Epub Feb. 19, 2008.
Hudson et al., High avidity scFv multimers; diabodies and triabodies. J Immunol Methods. Dec. 10, 1999;231(1-2):177-89.
Ko et al., Production of antibodies in plants: approaches and perspectives. Curr Top Microbiol Immunol. 2009;332:55-78. doi: 10.1007/978-3-540-70868-1_4.
Mikulecký et al., Increasing affinity of interferon-γ receptor 1 to interferon-γ by computer-aided design. Biomed Res Int. 2013;2013:752514. 12 pages. doi: 10.1155/2013/752514. Epub Oct. 2, 2013.
Pakula et al., Genetic analysis of protein stability and function. Annu Rev Genet. 1989;23:289-310.
Sikora et al., SMR proteins SugE and EmrE bind ligand with similar affinity and stoichiometry. Biochem Biophys Res Commun. Sep. 16, 2005;335(1):105-11.
Stech et al., A continuous-exchange cell-free protein synthesis system based on extracts from cultured insect cells. PLoS One. May 7, 2014;9(5):e96635. doi: 10.1371/journal.pone.0096635. eCollection 2014.
Walsh et al., The high- and low-affinity receptor binding sites of growth hormone are allosterically coupled. Proc Natl Acad Sci U S A. Dec. 7, 2004;101(49):17078-83. Epub Nov. 24, 2004.
Wang et al., All human Na(+)-K(+)-ATPase alpha-subunit isoforms have a similar affinity for cardiac glycosides. Am J Physiol Cell Physiol. Oct. 2001;281(4):C1336-43.
Zhao et al., In vivo selection of respiratory syncytial viruses resistant to palivizumab. J Virol. Apr. 2005;79(7):3962-8.
Ibanez et al.,Nanobodies with in vitro neutralizing activity protect mice against H5N1 influenza virus infection. J Infect Dis. Apr. 15, 2011;203(8):1063-72.
Kim et al., Respiratory syncytial virus disease in infants despite prior administration of antigenic inactivated vaccine. Am J Epidemiol. Apr. 1969;89(4):422-34.
Schepens et al., Nanobodies® specific for respiratory syncytial virus fusion protein protect against infection by inhibition of fusion. J Infect Dis. Dec. 1, 2011;204(11):1692-701. doi: 10.1093/infdis/jir622. Epub Oct. 12, 2011.
Serruys et al., In vitro inhibition of HbsAg secretion by single-domain intrabodies, 12th International Symposium on Viral Hepatitis and Liver Disease, Jul. 1-5, 2006, Paris (Poster).
Serruys et al., HBsAg-specific single-domain intrabodies reduce the secretion of Hepatitis B virus and HBsAg in vivo, Novel Compounds and Strategies to Combat Pathogenic Microorganisms (Symposium Belgian Society for Microbiology), Nov. 24, 2006, Brussels (Poster).
Serruys et al., Generation, characterization and in vitro study of Hepatitis B surface antigen specific single-domain intrabodies, International Meeting on The Molecular Biology of Hepatitis B Viruses, Sep. 16-20, 2007, Rome (Poster).
Serruys et al., Single-domain intrabodies inhibit Hepatitis B Virus replication in mice, International Meeting on The Molecular Biology of Hepatitis B Viruses, Sep. 16-20, 2007, Rome (Poster).
Serruys, Single domain-intrabodies against the Hepatitis B virus (HBV) New Insights in HBV Diversity, Pathogenesis, Diagnosis and Treatment, Dec. 12-14, 2007, Ghent (Oral Presentation).
Serruys et al., Single-Domain Intrabodies Inhibit Hepatitis B Virus (HBV) Replication in Mice (NBC-12), Mar. 13-14, 2008, Ede (Oral Presentation).
Wu et al., Ultra-potent antibodies against respiratory syncytial virus: effects of binding kinetics and binding valence on viral neutralization. J Mol Biol. Jul. 1, 2005;350(1):126-44.

* cited by examiner

Figure 12
LG192C10
LG20611H
LG20612F
LG192A8
LG20610F
LG20611D
LG2067E
LG2079G
LG192C4
LG2066A
LG2065A
LG2063A
LG2063D
LG2064G
LG192F2
LG2064D
LG192C6
LG2065E
LG192H2
LG2062A
LG2075D
LG2063E
LG2062G
LG2062H
LG2063C
LG191D3
LG2062F
LG2076B
LG2063F
LG2071D
LG191B9
LG2079A
LG2079B
LG2079H
LG20610C
LG20610D
LG192D3
LG20610B
LG2079D
LG20711D
LG20711E
LG20610E
LG191E4
LG2071C
LG2071F
LG2075C
LG2071E
LG2074D
LG2062E
LG2067H
LG20711F
LG2079F
LG20711H
LG192B1
LG2063B
LG20711B
LG2074H
LG192H1
LG2066D
LG2067B
LG20711A
LG2071A
LG2075B
LG2074A
LG2074B
LG2076A
LG2076D
LG2071B
LG2075A
LG2076C
LG2075E
LG2076E
LG2076F
LG20711G
LG2079C
LG2067G
LG2079E
LG2062C
LG2067C

| | IC50 |
|---|---|
| 192C4 | 0.7254 |
| 191D3 | 0.3630 |
| 192F2 | 2.606 |
| 101F FAB | 0.7668 |
| Synagis FAB | 0.7356 |
| Synagis MAB | 0.01995 |

Pulmonary delivered Nanobodies are stable in the lung for at least 24 hrs post-administration

- Exposure in BALF after intra-tracheal administration for at least 24 hrs

| Fraction of Dose | Max. Fraction (%) | Fraction 24 hrs (%) |
|---|---|---|
| **NB1** mono-valent | 35.7 - 49.5 | 8.46 - 12.4 |
| **NB2** bivalent | 74.0 - 98.3 | 12.5 - 16.5 |
| **NB3** trivalent | 47.1 - 67.4 | 11.4 - 15.0 |

Figure 42
Bioavailability in plasma of pulmonary administered vs *i.v.* administered Nanobodies
| intravenous administration | clearance (ml/hr/kg) | terminal half life (hrs) |
|---|---|---|
| NB1 monovalent | 363 | 0.926 |
| NB2 bivalent | 337 | 2.06 |
| NB3 trivalent | 9.00 | 12.6 |
| intra-tracheal administration | bioavail-ability (%) | terminal half life (hrs) |
|---|---|---|
| NB1 monovalent | 22.1 | 9.48 |
| NB2 bivalent | 13.9 | 10.5 |
| NB3 trivalent | 6.9 | 13.0 |
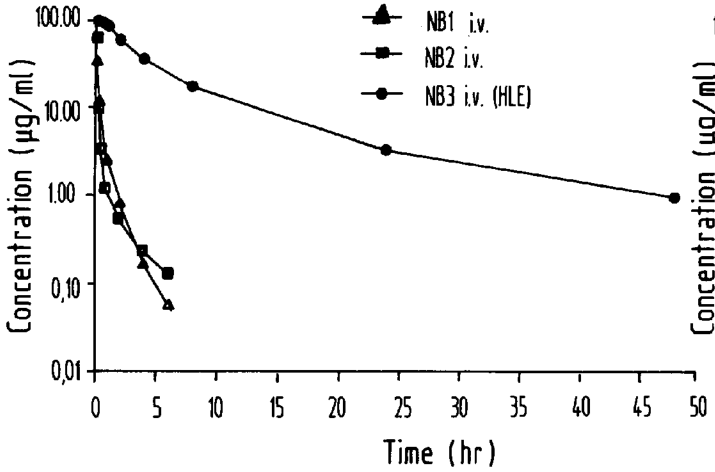
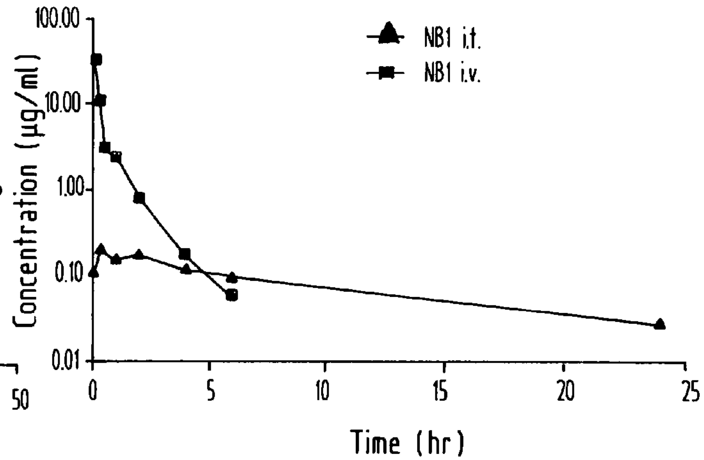

Neutralisation of virulent CVS-11 strain with bivalent or biparatopic nanobodies with the brain as susceptible target organ:

Linker modules

| | |
|---|---|
| (1) G1 hinge | EPKSCDKTHTCPPCP (SEQ ID NO: 2660) |
| (2) 9GS-G1 hinge | GGGGSGGGSEPKSCDKTHTCPPCP (SEQ ID NO: 2661) |
| (3) G3 hinge | ELKTPLGDTTHTCPRCPEPKSCDTPPPCPRCP EPKSCDTPPPCPRCPEPKSCDTPPPCPRCP (SEQ ID NO: 2640) |
| GS9 | GGGGSGGGS (SEQ ID NO: 2639) |
| GS15 | GGGGSGGGGSGGGGS (SEQ ID NO: 2662) |

Figure 47 A-C

M: Marker; 1: pos control (100ng NB2biv); 2: mouse 1; 3: mouse 2; 4: mouse 3; 5: mouse 4; 6: mouse 5

| | V5L | A14P | S19R | I20L | E44G | G54D | A74S | G78L | A83R | D85E | R105Q | Q108L | # mutations |
|---|---|---|---|---|---|---|---|---|---|---|---|---|---|
| NC41v01 | l | p | r | l | g | . | . | l | . | e | q | l | 9 |
| NC41v02 | l | p | r | . | g | . | s | l | . | e | q | l | 9 |
| NC41v03 | l | p | r | . | g | . | s | l | r | e | q | l | 10 |
| NC41v04 | l | p | . | . | g | . | s | l | r | . | q | l | 8 |
| NC41v05 | l | p | . | . | g | . | s | l | . | e | q | l | 8 |
| NC41v06 | l | p | r | l | g | d | . | l | r | e | q | l | 11 |
| NC41v07 | l | p | . | . | g | . | . | l | . | . | q | l | 6 |
| NC41v08 | l | p | . | . | g | . | . | . | r | e | q | l | 7 |
| NC41v09 | l | p | . | . | g | . | s | . | r | . | q | l | 7 |
| NC41v10 | l | p | . | . | g | . | . | . | . | . | q | l | 5 |
| NC41v11 | l | . | . | . | g | . | . | . | . | . | q | l | 4 |
| NC41v12 | l | p | . | . | . | . | . | . | . | . | q | l | 4 |
| NC41v13 | l | p | r | l | g | . | . | . | . | e | q | l | 8 |
| NC41v14 | l | p | r | l | g | . | s | l | . | e | q | l | 10 |
| NC41v15 | l | . | r | l | g | . | . | l | . | e | q | l | 8 |
| NC41v16 | l | p | r | l | . | . | . | l | . | e | q | l | 8 |
| NC41v17 | l | p | r | l | g | . | s | l | r | e | q | l | 11 |
| NC41v18 | l | p | r | l | g | d | s | l | r | e | q | l | 12 |

Figure 67
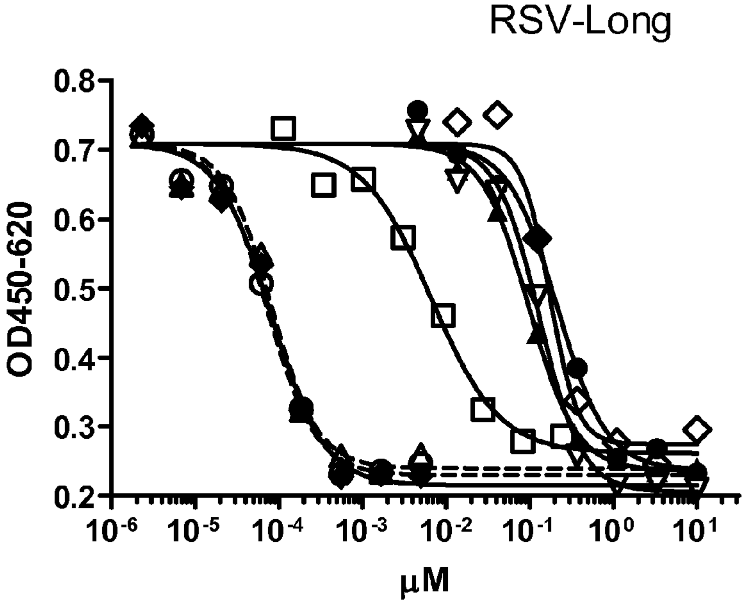
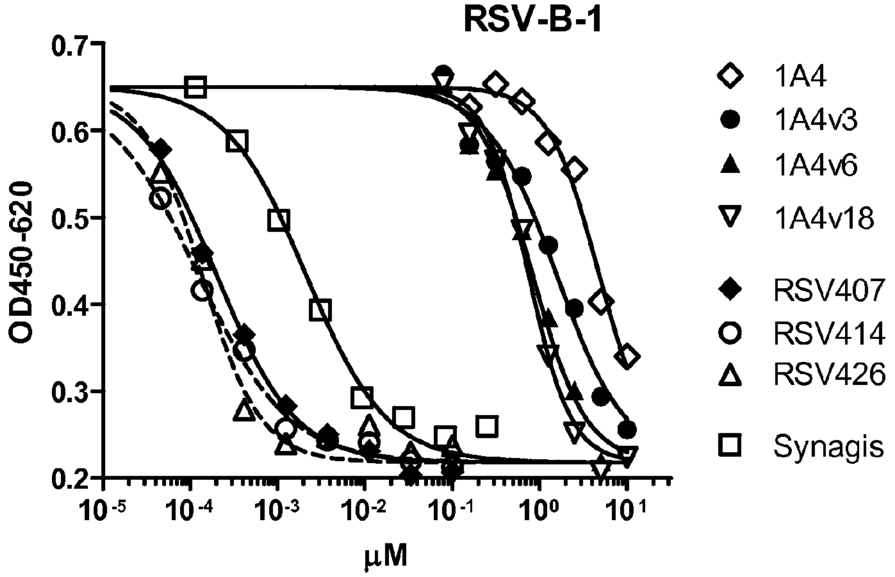

AMINO ACID SEQUENCES DIRECTED AGAINST ENVELOPE PROTEINS OF A VIRUS AND POLYPEPTIDES COMPRISING THE SAME FOR THE TREATMENT OF VIRAL DISEASES

RELATED APPLICATIONS

This application is a national stage filing under 35 U.S.C. §371 of international application PCT/EP2009/056975, filed Jun. 5, 2009, which was published under PCT Article 21(2) in English, and claims the benefit under 35 U.S.C. §119(e) of U.S. provisional application Ser. No. 61/059,055, filed Jun. 5, 2008, U.S. provisional application Ser. No. 61/092,991, filed Aug. 29, 2008, U.S. provisional application Ser. No. 61/139,130, filed Dec. 19, 2008, U.S. provisional application Ser. No. 61/144,653, filed Jan. 14, 2009, U.S. provisional application Ser. No. 61/172,914, filed Apr. 27, 2009, and U.S. provisional application Ser. No. 61/174,108, filed Apr. 30, 2009, the disclosures of which are incorporated by reference herein in their entireties.

FIELD OF THE INVENTION

The present invention relates to amino acid sequences that are directed against and/or that can specifically bind to an envelope protein of a virus, as well as to compounds or constructs, and in particular proteins and polypeptides, that comprise or essentially consist of one or more such amino acid sequences (also referred to herein as "amino acid sequences of the invention", "compounds of the invention", and "polypeptides of the invention", respectively).

The invention also relates to nucleic acids encoding such amino acid sequences and polypeptides (also referred to herein as "nucleic acids of the invention" or "nucleotide sequences of the invention"); to methods for preparing such amino acid sequences and polypeptides; to host cells expressing or capable of expressing such amino acid sequences or polypeptides; to compositions, and in particular to pharmaceutical compositions, that comprise such amino acid sequences, polypeptides, nucleic acids and/or host cells; and to uses of such amino acid sequences or polypeptides, nucleic acids, host cells and/or compositions, in particular for prophylactic, therapeutic or diagnostic purposes, such as the prophylactic, therapeutic or diagnostic purposes mentioned herein.

Other aspects, embodiments, advantages and applications of the invention will become clear from the further description herein.

BACKGROUND ART

Enveloped viruses assemble by budding at membranes of host cells (Compans et al. In *Comprehensive Virology*, Fraenkel and Wagner, eds. Plenum Press, New York 4: 179-252 (1975); Choppin and Compans, In *Comprehensive Virology*, Fraenkel and Wagner, eds. Plenum Press, New York 4: 96-178 (1975); Wagner, In *Comprehensive Virology*, Fraenkel and Wagner, eds. Plenum Press, New York 4:1-94 (1975)). During this process they acquire an envelope which has a lipid bilayer, whose composition reflects that of the host membrane, glycoproteins that form projections or spikes on the surface of the virus particles, and non-glycosylated M-proteins which are associated with the interior surface of the lipid bilayer of the virus particle. The virion-associated proteins are virus specific.

One of the crucial steps in virus infection is the fusion between the virus membrane and the membrane of the host cell, which is mediated by viral glycoproteins, such as viral attachment proteins and viral fusion proteins.

This virus membrane fusion can take place either at the plasma membrane or at an intracellular location following virus uptake by endocytosis (Earp et al. *Curr. Topics Microbiol. Immunol.* 285, 25-66 (2005); Smith et al. *Science* 304, 237-242 (2004)). Viruses belonging to the Retroviridae, Paramyxoviridae, Herpesviridae, and Coronaviridae families typically initiate fusion in a pH-independent manner whereby the virion initially binds to cell surface receptors and subsequently the viral membrane fuses with the plasma membrane of the host cell at neutral pH.

A second, more complex route of entry is characterized by receptor-mediated such as clathrin-dependent, caveola-dependent uptake or non-clathrin-dependent, non-caveola dependent uptake (Smith et al. *Science* 304, 237-242 (2004); Sieczkarski et al. *Curr. Topics Microbiol. Immunol.* 285, 1-23 (2005)). Viruses that use such routes frequently have fusion reactions that require exposure to mildly acidic pH within organelles of the endocytic pathway (Helenius et al. *J. Cell Biol.* 84, 404-420 (1980)). Viruses belonging to the Orthomyxoviridae, Togaviridae, Rhabdoviridae, Bunyaviridae, and Arenaviridae families often require a low-pH-mediated event for efficient fusion of viral and host cellular membranes.

The determination of the atomic structure of complete ectodomains or core regions of many viral fusion proteins in their pre- and/or post-fusion states has revealed a large diversity of conformations. Nevertheless, in all the cases studied so far, the structural transition from a pre- to a post-fusion conformation leads to a stable hairpin conformation resulting in the positioning of the two membrane anchors, the transmembrane and the fusion peptide domains, at the same end of a trimeric elongated rod-like structure. Three different classes of viral fusion proteins have been identified to date based on their common post-fusion structural motifs (Table C-3) (Kielian et al. *Nat. Rev. Microbiol.* 4: 67-76 (2006); Weissenhorn et al. *FEBS Lett.* 581, 2150-2155 (2007)).

In their final, post-fusion state, class I viral fusion proteins are characterized by the interaction of the membrane-proximal C-terminal regions with the more N-terminal trimeric α-helical coiled-coil domains to form a trimer of hairpins that brings the fusion peptides and transmembrane domains together (Skehel et al. *Cell* 95: 871-874 (1998)). Importantly, for several class I proteins, peptides containing sequences of these C-terminal or N-interacting regions can bind to the viral fusion protein and inhibit fusion and infection by preventing refolding to the final hairpin conformation (for review see Moore and Doms *Proc. Natl. Acad. Sci. USA.* 100: 10598-10602 (2003)). The final trimeric hairpin structure is often referred to as a six-helix bundle. The structures of two class I proteins have also been crystallographically determined with respect to their state prior to activation of fusion. For one protein, influenza virus hemagglutinin (HA), this initial state does not exhibit the six-helix bundle (Wilson et al. *Nature* 289: 366-373 (1981)), whereas for the other, simian parainfluenza virus 5 fusion (F) protein, a six-helix bundle is already present (Yin et al. *Proc. Natl. Acad. Sci. USA* 102: 9288-9293 (2005)), but this structure is not identical to the final bundle. In both cases, in transiting from their initial to their final state, the proteins undergo changes in secondary structure that cause parts of the protein, notably fusion peptides, to move long distances (Baker et al. *Mol. Cell* 3: 309-319 (1999). Chen et al. *Proc. Natl. Acad. Sci. USA* 96: 8967-8972 (1999)). Examples of virus families that express class I fusion proteins are the Orthomyxoviridae, the Paramyxoviridae, the Filoviridae, the Retroviridae and the Coronaviridae.

Viruses that are known to express class II proteins belong to the genus of alphaviruses (family Togaviridae) and to the family of Flaviviridae (Kielian et al. *Virology* 344: 38-47 (2006)). Alphaviruses and flaviviridae are small, spherical viruses containing plus-strand RNA genomes packaged with a capsid protein. The nucleocapsid is enveloped by a lipid bilayer containing the virus membrane fusion protein (alphavirus E1 or flavivirus E). In mature virions, alphavirus E1 is associated as a heterodimer with the viral E2 protein, whereas the flavivirus E protein is found as an E-E homodimer. Low pH causes a dramatic rearrangement of the fusion protein to the post-fusion conformation, dissociating its dimeric interactions and producing a target membrane-inserted homotrimer that is believed to drive the membrane fusion reaction. Although the alphavirus and flavivirus fusion proteins do not have detectable amino acid sequence similarity, they have remarkably similar secondary and tertiary structures, indicating their evolutionary relationship and leading to their classification as the inaugural members of the class II virus fusion proteins (Lescar et al. Cell 105: 137-148 (2001)). The neutral pH (i.e. pre-fusion) structures of the fusion protein ectodomains have been determined for the alphavirus Semliki Forest virus (SFV; Lescar et al. Cell 105: 137-148 (2001)) and the flaviviruses TBE, DV2, and DV3 (Rey 375: 291-298 (1995); Modis Proc. Natl. Acad. Sci. USA 100: 6986-6991 (2003)). The proteins are elongated molecules composed almost entirely of β-strands and contain three domains: domain I, which is located centrally; domain II, which is located at one side of domain I and contains the target-membrane-interacting fusion peptide loop at its tip; and an Ig-like domain III, which is connected to the other side of domain I. Although not present in the ectodomain structure, in the full-length proteins the stem region and transmembrane anchor are found at the C-terminus of domain III, at the opposite end of the protein from the fusion loop. The fusion proteins are arranged with icosahedral symmetry and lie tangential (almost parallel) to the virus membrane. The conformational changes of class II fusion proteins necessary to transit from the crystallographically determined initial state to the final state do not involve substantial changes in secondary structure. Instead, the domains of class II proteins rotate at “pivot points” so that large-scale movements bring fusion loops and transmembrane domains into proximity, forming trimers of hairpins composed of β-structures.

A third class of fusion proteins forms in its post-fusion state trimers of hairpins by combining two structural elements. Similar to class I fusion proteins, class III fusion proteins display a central α-helical trimeric core; however, each fusion domain exposes two fusion loops located at the tip of an elongated β-sheet revealing a striking convergence with class II fusion proteins (Roche et al. *Science* 313: 187-191 (2006); Heldwein et al. *Science* 313: 217-220 (2006)). Examples of virus families that express class III fusion proteins are the Rhabdoviridae and the Herpesviridae.

Up to now, neutralizing antibodies have been crucial for protection against diseases associated with enveloped viruses. In principle, such antibodies can act against both free virus and against infected cells. The most marked antiviral activity of antibodies and the activity that is most important for antibody-mediated protection is the neutralization of free virus particles. The antiviral activity towards free virus particles can be achieved by binding of the antibody to a specific target on the virion surface, such as an envelope protein which can result in the inhibition of viral infection (neutralization) and/or in the triggering of effector systems that can lead to viral clearance. Antibodies that are specifically directed against infected cells can also mediate several antiviral activities. Fc-mediated effector systems can lead to cell lysis or clearance by antibody-dependent cellular cytotoxicity (ADCC) or complement-dependent cytotoxicity (CDC). The inhibition of viral replication inside cells by the binding of antibodies to viral molecules that are expressed at the membrane of the cells, presumably through signalling mechanisms, has also been described, particularly for viral infection of neurons (Fujinami et al. *Nature* 279: 529-530 (1979); Levine et al. *Science* 254: 856-860 (1991)). Antibodies can also inhibit the release of viruses from infected cells (Gerhard et al. *Curr. Top. Microbiol. Immunol.* 260: 171-190 (2001)) and the cell-cell transmission of viruses (Pantaleo et al. *Eur. J. Immunol.* 25: 226-231 (1995); Burioni et al. *Proc. Natl. Acad. Sci. USA* 91: 355-359 (1994)). Neutralizing antibodies tend to be effective against both infected cells and free virus particles because they bind to envelope molecules that are presented on infected cells as well as on virions. However, non-neutralizing antibodies might also be effective against infected cells by binding to molecules that are expressed on infected cells, but not on virions, for example the M2 protein of influenza virus (Fiers et al. *Virus Research* 103 (1-2): 173-176 (2004)). Okuno et al. (1993, J. Virol. 67: 2552-2558) describe a monoclonal antibody (MAb C179) that binds to the stem region of HA and inhibits the fusion activity of HA resulting in virus neutralization and inhibition of cell fusion.

Clinically, antibody therapy using polyclonal and monoclonal antibodies (mAbs) is effectively used as prophylaxis against varicella, hepatitis A, hepatitis B, rabies (Montano-Hirose et al. *Vaccine* 11: 1259-1266 (1993) and Schumacher et al. *Vaccine* 10: 754-760 (1992)), and respiratory syncytial virus infections (Sawyer *Antiviral Res.* 47: 57-77 (2000)). Within the last 10 years, two antibodies have been licensed for a viral indication, RespiGam and Synagis®, both for prevention of respiratory syncytial virus infection. RespiGam is a human plasma derived antibody and Synagis® is a humanized monoclonal antibody, the first such antibody to be licensed for an infectious disease indication. CytoGam for prevention of cytomegalovirus infection in kidney transplant patients has recently been granted an expanded indication to include use in lung, liver, pancreas and heart transplant patients. Antibody-based therapy for human patients with influenza is up to now little explored. Nabi-HB is a human plasma derived antibody marketed to treat HBV acute or perinatal exposure. However, it has been shown that specific monoclonal antibodies can confer prophylactic and therapeutic protection against influenza in mice (Smirnov et al. *Arch Virol.* 145: 1733-1741 (2000); Renegar et al. *J Immunol.* 173: 1978-1986 (2004); Palladino et al. *J Virol.* 69: 2075-2081 (1995)). Humanized mouse mAbs and equine F(ab')2 fragments specific for hemagglutinin H5 protein of the influenza virus have also been used for efficacious prophylaxis and therapy in the mouse model (Lu et al. *Respir Res.* 7: 43 (2006); Hanson et al. *Respir Res.* 7: 126 (2006)).

Antibody fragments, such as F(ab')2 fragments, Fab fragments (Lamarre et al. *J. Immunol.* 154: 3975-3984 (1995); Thullier et al. *J. Biotechnol.* 69: 183-190 (1999); Schofield et al. *J. Gen. Virol.* 78: 2431-2439 (1997); Barbas et al. PNAS 89:10164 (1992); Crowe et al. PNAS 91: 1386 (1994); Prince et al. JVI 64: 3091 (1990)) and single chain Fv fragments (Mason et al. *Virology* 224: 548 (1996)) have also proven to be successful in neutralizing a variety of enveloped viruses both in vitro and in vivo in animal models (predominantly in mice).

Variable domains derived from camelid species heavy chain antibodies have been generated against the nucleoprotein of Marburg virus (Sherwood et al. al. *J. Infect. Dis.* 196

(2): S213-219 (2007)), against p15 matrix protein of porcine retroviruses (Dekker et al. *J. Virol.* 77 (22): 12132-12139 (2003)), against the HBsAg of human Hepatitis B virus (Serruys et al. 12$^{th}$ *International Symposium on Viral Hepatitis and Liver Disease* (2006); Serruys et al. *Novel compounds & strategies to combat pathogenic microorganisms* (*poster*) (2006); Serruys et al. *The Molecular Biology of Hepatitis B Viruses* (*poster*) (2007); Serruys *New insights in HBV diversity, pathogenesis, diagnosis and treatment* (*oral presentation*) (2007); Serruys *NBC-12: Single-domain intrabodies inhibit Hepatitis B virus replication in mice* (*oral presentation*) (2008)), against vaccinia virus (Goldman et al. *Anal. Chem.* 78 (24): 8245-8255 (2006)), and against gp120 of HIV-1 (Forsman et al. *Abstract EU-WHO Neut Workshop*, Italy, March 2007) in some cases resulting in effective blocking of viral replication or neutralization in vitro and/or in vivo (in a mouse model).

The prior art discussed hereabove clearly indicates that the development of effective and potent antiviral drugs remains a major scientific challenge. Only for a minority of viral infections, there is currently an effective prophylactic and/or therapeutic compound available.

However, these currently existing antiviral drugs, have numerous side-effects, such as nausea, vomiting, skin rashes, migraine, fatigue, trembling, and, more rarely, epileptic seizures.

Also, the mutability and resultant adaptability of viruses present an enormous difficulty to the design of antiviral strategies that are effective over the long term. While drug design has gained from advances in the molecular understanding of viral growth processes, many initially potent drugs lose their efficacy over time because of the emergence of drug-resistant strains. When mutations arise that attenuate or compensate for the inhibitory effect of the drug, virus strains that carry such mutations gain a growth advantage and are subsequently selected for in the viral population.

Hence, for the majority of currently known human viral diseases there is an urgent need for a potent antiviral drugs that can be used for effective treatment and prevention of these diseases. In addition, a need exists for alternative and improved antiviral drugs over the presently existing drugs with regard to efficacy and/or potency (over the long term), overcoming currently encountered disadvantages, such as for instance undesired side-effects and viral evasion/viral escape.

SUMMARY OF THE INVENTION

It is an object of the present invention to provide amino acid sequences that are directed against and/or that can specifically bind to an envelope protein of a virus. The amino acid sequences according to the present invention, that are directed against and/or specifically binding to an envelope protein of a virus, can generally be used to modulate, and in particular to inhibit and/or to prevent the viral-mediated biological pathways in which an envelope protein of a virus and/or a viral receptor are involved. In particular, the amino acid sequences of the present invention can be used to neutralize a virus (as defined herein) and/or to modulate, reduce and/or inhibit the infectivity of a virus (as defined herein).

More specifically, the amino acid sequences according to the present invention may neutralize a virus (as defined herein) and/or modulate, reduce and/or inhibit the infectivity of a virus (as defined herein) in the pre-entry phase of viral infection (i.e. before and/or during viral entry in a target host cell has taken place) and/or in the post-entry phase of viral infection (i.e. after viral entry in a target host cell has taken place). Accordingly, amino acid sequences of the present invention that neutralize a virus (as defined herein) and/or modulate, reduce and/or inhibit the infectivity of a virus (as defined herein) in the pre-entry phase of viral infection (i.e. before and/or during viral entry in a target host cell has taken place), are said herein to modulate and in particular inhibit and/or prevent viral entry (as further defined herein) in a target host cell. Furthermore, amino acid sequences of the present invention that neutralize a virus (as defined herein) and/or modulate, reduce and/or inhibit the infectivity of a virus (as defined herein) in the post-entry phase of viral infection (i.e. after viral entry in a target host cell has taken place), are said herein to modulate and in particular inhibit and/or prevent viral replication (as further defined herein) in a target host cell.

Accordingly, the amino acid sequences of the present invention can modulate and in particular inhibit and/or prevent viral entry and/or viral replication in a target host cell by specifically binding to an envelope protein of a virus at any suitable stage of said biological pathway(s); preferably, the amino acid sequences of the present invention can modulate and in particular inhibit and/or prevent viral entry in a target host cell by binding to an envelope protein of a virus, such that virion aggregation is induced and/or virion structure is destabilized and/or virion attachment to a target host cell is modulated, inhibited and/or prevented (for instance by modulating and/or inhibiting and/or preventing the interaction between the envelope protein of a virus and a viral receptor and/or between the envelope protein of a virus and a target host cell or by competing with said envelope protein for binding to said viral receptor and/or said target host cell) and/or viral fusion with said target host cell is modulated, inhibited and/or prevented (for instance at the target host cell membrane or within an endosomal and/or lysosomal compartment of said target host cell), for example by preventing said envelope protein of a virus from undergoing a conformational change. Alternatively, the amino acid sequences of the present invention can modulate and in particular inhibit and/or prevent viral replication (as defined herein) in a target host cell by specifically binding to an envelope protein of a virus at any suitable stage of said biological pathway; preferably, the amino acid sequences of the present invention can modulate and in particular inhibit and/or prevent viral replication in a target host cell by binding to an envelope protein of a virus, such that transcription and/or translation of the viral genome is affected, inhibited and/or prevented and/or viral packaging and/or the formation of functional virions is affected, inhibited and/or prevented and/or budding of nascent virions from the target host cell membrane is reduced, inhibited and/or prevented.

As such, the polypeptides and compositions of the present invention can be used for the prevention and treatment (as defined herein) of viral diseases. Generally, "viral diseases" can be defined as diseases and disorders that are caused by one or more viruses; in particular viral diseases may be diseases that can be prevented and/or treated, respectively, by suitably administering to a subject in need thereof (i.e. having the disease or disorder or at least one symptom thereof and/or at risk of attracting or developing the disease or disorder) of either an amino acid sequence, polypeptide or composition of the invention (and in particular, of a pharmaceutically active amount thereof) and/or of a known anti-viral compound against an envelope protein of a virus or a viral-mediated biological pathway in which an envelope protein of a virus and/or its viral receptor is involved (and in particular, of a pharmaceutically active amount thereof). Examples of such viral diseases will be clear to the skilled person based on the disclosure herein, and for example include the following diseases and disorders (caused by the following viruses): AIDS (caused by HIV), AIDS Related Complex (caused by HIV), Aseptic meningitis (caused by HSV-2), Bronchiolitis (caused by e.g. RSV [RSV virus and diseases caused by RSV are reviewed by Ogra P. *Paediatric Respiratory Reviews* 5: S119-S126 (2004)]), California encephalitis (caused by California encephalitis virus), Chickenpox (caused by Varicella zoster virus), Colorado tick fever (caused by Colorado tick fever virus), Common cold (caused by e.g. RSV [RSV virus and diseases caused by RSV are reviewed by Ogra P. *Paediatric Respiratory Reviews* 5: S119-S126 (2004)] or Parainfluenza virus), Conjunctivitis (caused by e.g. Herpes simplex virus), Cowpox (caused by vaccinia virus), Croup (caused by e.g. parainfluenza viruses 1 to 3), Cytomegalovirus Infection (caused by cytomegalovirus), Dengue fever (caused by dengue virus), Eastern equine encephalitis (caused by EEE virus), Ebola hemorrhagic fever (caused by Ebola virus), encephalitis and chronic pneumonitis in sheep (caused by Visna virus), encephalitis (caused by Semliki Forest virus), Gingivostomatitis (caused by HSV-1), Hantavirus hemorrhagic fever/Hantaan-Korean hemorrhagic fever (caused by Hantavirus), Hepatitis (caused by Hepatitis virus), Genital herpes (caused by HSV-2), Herpes labialis (caused by HSV-1), neonatal herpes (caused by HSV-2), Genital HSV (caused by Herpes simplex virus), Infectious mononucleosis (caused by e.g. Epstein-Barr virus), Influenza (Flu) (caused by influenza viruses A, B and C [Influenza viruses, diseases caused by influenza viruses and pharmaceuticals to treat these diseases are reviewed by Subbarao et al. *Nat. Rev. Immunol.* 7: 267-278 (2007)]), Japanese encephalitis virus (caused by JEE virus), Keratoconjunctivitis (caused by HSV-1), Lassa fever, Leukemia and lymphoma (caused by e.g. Human T cell leukemia virus or Moloney murine leukemia virus), Lower respiratory tract infections (caused by e.g. RSV [RSV virus and diseases caused by RSV are reviewed by Ogra P. *Paediatric Respiratory Reviews* 5: S119-S126 (2004)] or Sendai virus), Measles (caused by rubeola virus), Marburg hemorrhagic fever (caused by Marburg virus), Molluscum contagiosum (caused by Molluscum), Mononucleosis-like syndrome (caused by CMV), mumps (caused by mumps virus), Newcastle disease (caused by avian paramoxyvirus 1), Norovirus, Orf (caused by Orfvirus), Pharyngitis (caused by e.g. RSV [RSV virus and diseases caused by RSV are reviewed by Ogra P. *Paediatric Respiratory Reviews* 5: S119-S126 (2004)], Influenza Virus [Influenza viruses, diseases caused by influenza viruses and pharmaceuticals to treat these diseases are reviewed by Subbarao et al. Nat. Rev. Immunol. 7: 267-278 (2007)], Parainfluenza virus and Epstein-Barr virus), Pneumonia (viral) (caused by e.g. RSV [RSV virus and diseases caused by RSV are reviewed by Ogra P. *Paediatric Respiratory Reviews* 5: S119-S126 (2004)] or CMV), Progressive multifocal leukencephalopathy, Rabies (caused by Rabies virus [rabies virus and diseases caused by rabies are reviewed by Woldehiwet Z. *Res. Vet. Sci.* 73: 17-25 (2002) and Dietzschold et al. *J. Virol.* 56: 12-18 (1985)]), Roseola (caused by HHV-6), Rubella (caused by rubivirus), SARS (caused by a human coronavirus), Shingles (caused by Varicella zoster virus), Smallpox (caused by Variola virus), St. Louis encephalitis (caused by SLE virus), Strep Throat (caused by e.g. RSV [RSV virus and diseases caused by RSV are reviewed by Ogra P. *Paediatric Respiratory Reviews* 5: S119-S126 (2004)], Influenza Virus [Influenza viruses, diseases caused by influenza viruses and pharmaceuticals to treat these diseases are reviewed by Subbarao et al. *Nat. Rev. Immunol.* 7: 267-278 (2007)], Parainfluenza virus, Epstein-Barr virus), Sindbis fever (Sindbis virus), Temporal lobe encephalitis (caused by HSV-1), Urethritis (caused by Herpes simplex virus), Vesicular stomatitis (caused by vesicular stomatitis virus), Viral encephalitis, Viral gastroenteritis, Viral meningitis, Viral pneumonia, Western equine encephalitis (caused by WEE virus), West Nile disease, Yellow fever (caused by Yellow Fever virus), and Zoster (caused by Varicella zoster virus). The amino acid sequences, polypeptides and compositions according to the invention can be used to treat any of the foregoing viral diseases. Other examples of such viral diseases will be clear to the skilled person; for instance, the amino acid sequences, polypeptides and compositions according to the invention can be used to treat any of the viral diseases that are disclosed in the handbook "Fields Virology", $5^{th}$ edition (2007) by David M. Knipe, PhD; Peter M. Howley, MD; Diane E. Griffin, MD, PhD; Robert A. Lamb, PhD, ScD; Malcolm A. Martin, MD; Bernard Roizman, ScD; Stephen E. Straus, MD (ISBN-10: 0781760607; ISBN-13: 9780781760607).

Accordingly, the amino acid sequences, polypeptides and compositions of the present invention can be used for the prevention and treatment of viral diseases which are characterized by viral-mediated biological pathway(s) in which an envelope protein of a virus and/or a viral receptor are involved.

In particular, the amino acid sequences, polypeptides and compositions of the present invention can be used for the prevention and treatment of viral diseases characterized by any viral-mediated biological pathway(s) in which an envelope protein of a virus and/or a viral receptor are involved. However, preferably, the amino acid sequences, polypeptides and compositions of the present invention can be used for the prevention and treatment of viral diseases characterized by viral entry in a target host cell, such as virion attachment to a target host cell and/or viral fusion with a target host cell. Also preferably, the amino acid sequences, polypeptides and compositions of the present invention can be used for the prevention and treatment of viral diseases characterized by viral replication in a target host cell, such as viral transcription and/or viral translation and/or viral packaging and/or the formation of functional virions and/or budding of nascent virions from the target host cell membrane.

Some specific, but non-limiting examples of such uses are:

- Amino acid sequences and polypeptide of the invention against hemagglutinin H5, and pharmaceutical compositions comprising the same, may be used in the prevention and treatment of influenza (flu), pharyngitis, strep throat, common cold and respiratory tract infections;
- Amino acid sequences and polypeptide of the invention against hRSV, and pharmaceutical compositions comprising the same, may be used in the prevention and treatment of lower respiratory tract infections, bronchiolitis, common cold, pharyngitis, viral pneumonia and strep throat;
- Amino acid sequences and polypeptide of the invention against rabies, and pharmaceutical compositions comprising the same, may be used in the prevention and treatment of rabies, brain inflammation and (acute) encephalitis;

Other examples of such uses will be clear to the skilled person based on the disclosure herein.

Thus, without being limited thereto, the amino acid sequences, polypeptides and compositions of the invention can for example be used to prevent and/or to treat all diseases and disorders that are currently being prevented or treated with known anti-viral compounds that can modulate viral-mediated biological pathway(s) in which an envelope protein of a virus and/or a viral receptor are involved, such as those mentioned in the prior art cited above. It is also envisaged that the amino acid sequences, polypeptides and compositions of the invention can be used to prevent and/or to treat all diseases and disorders for which treatment with such anti-viral compounds is currently being developed, has been proposed, or will be proposed or developed in future. In addition, it is envisaged that, because of their favourable properties as further described herein, the amino acid sequences, polypeptides and compositions of the present invention may be used for the prevention and treatment of other diseases and disorders than those for which these known anti-viral compounds are being used or will be proposed or developed; and/or that the amino acid sequences, polypeptides and compositions of the present invention may provide new methods and regimens for treating the diseases and disorders described herein.

Other applications and uses of the amino acid sequences and polypeptides of the invention will become clear to the skilled person from the further disclosure herein.

Generally, it is an object of the invention to provide pharmacologically active agents, as well as compositions comprising the same, that can be used in the diagnosis, prevention and/or treatment of viral diseases and of the further diseases and disorders mentioned herein; and to provide methods for the diagnosis, prevention and/or treatment of such diseases and disorders that involve the administration and/or use of such agents and compositions.

In particular, it is an object of the invention to provide such pharmacologically active agents, compositions and/or methods that have certain advantages compared to the agents, compositions and/or methods that are currently used and/or known in the art. These advantages will become clear from the further description below.

More in particular, it is an object of the invention to provide therapeutic proteins that can be used as pharmacologically active agents, as well as compositions comprising the same, for the diagnosis, prevention and/or treatment of viral diseases and of the further diseases and disorders mentioned herein; and to provide methods for the diagnosis, prevention and/or treatment of such diseases and disorders that involve the administration and/or the use of such therapeutic proteins and compositions.

Accordingly, it is a specific object of the present invention to provide amino acid sequences that are directed against (as defined herein) an envelope protein of a virus, in particular against an envelope protein of a virus that is able to infect a warm-blooded animal, more in particular against an envelope protein of a virus that is able to infect mammalians, and especially against an envelope protein of a virus that is able to infect humans; and to provide proteins and polypeptides comprising or essentially consisting of at least one such amino acid sequence.

In particular, it is a specific object of the present invention to provide such amino acid sequences and such proteins and/or polypeptides that are suitable for prophylactic, therapeutic and/or diagnostic use in a warm-blooded animal, and in particular in a mammal, and more in particular in a human being.

More in particular, it is a specific object of the present invention to provide such amino acid sequences and such proteins and/or polypeptides that can be used for the prevention, treatment, alleviation and/or diagnosis of one or more diseases, disorders or conditions associated with viral entry and/or viral replication and/or mediated by an envelope protein of a virus and/or its viral receptor (such as the diseases, disorders and conditions mentioned herein) in a warm-blooded animal, in particular in a mammal, and more in particular in a human being.

It is also a specific object of the invention to provide such amino acid sequences and such proteins and/or polypeptides that can be used in the preparation of pharmaceutical or veterinary compositions for the prevention and/or treatment of one or more diseases, disorders or conditions associated with viral entry and/or viral replication and/or mediated by an envelope protein of a virus and/or its viral receptor (such as the diseases, disorders and conditions mentioned herein) in a warm-blooded animal, in particular in a mammal, and more in particular in a human being.

In the invention, generally, these objects are achieved by the use of the amino acid sequences, proteins, polypeptides and compositions that are described herein.

In general, the invention provides amino acid sequences that are directed against (as defined herein) and/or can specifically bind (as defined herein) to an envelope protein of a virus; as well as compounds and constructs, and in particular proteins and polypeptides, that comprise at least one such amino acid sequence. Preferably, said envelope protein of a virus against which the amino acid sequences and polypeptides of the invention are directed against and/or specifically bind to may be encoded by the viral genome, i.e. may be a viral-specific envelope protein. Alternatively, said envelope protein of a virus may also not be encoded by the viral genome but may for instance be encoded by the genome of "a target host cell of said virus" (as further defined herein). Furthermore, said envelope protein of a virus is preferably a membrane protein, which is bound to or attached to and/or embedded in and/or crosses the bi-lipid membrane layer of the viral envelope of said virus. In another preferred but non-limiting aspect, said envelope protein of a virus against which the amino acid sequences and polypeptides of the invention are directed and/or which is specifically bound by the amino acid sequences and/or polypeptides of the invention may be a glycoprotein. Alternatively, said envelope protein may be a non-glycosylated protein.

More in particular, the invention provides amino acid sequences that can bind to an envelope protein of a virus with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein; as well as compounds and constructs, and in particular proteins and polypeptides, that comprise at least one such amino acid sequence.

In particular, amino acid sequences and polypeptides of the invention are preferably such that they:

bind to an envelope protein of a virus with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);

and/or such that they:

bind to an envelope protein of a virus with a $k_{on}$-rate of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$;

and/or such that they:

bind to an envelope protein of a virus with a $k_{off}$ rate between 1 $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Preferably, a monovalent amino acid sequence of the invention (or a polypeptide that contains only one amino acid sequence of the invention) is preferably such that it will bind to an envelope protein of a virus with an affinity less than 500 nM, preferably less than 200 nM, more preferably less than 10 nM, such as less than 500 pM.

Some preferred IC50 values for binding of the amino acid sequences or polypeptides of the invention to an envelope protein of a virus will become clear from the further description and examples herein.

For binding to an envelope protein of a virus, an amino acid sequence of the invention will usually contain within its amino acid sequence one or more amino acid residues or one or more stretches of amino acid residues (i.e. with each "stretch" comprising two or more amino acid residues that are adjacent to each other or in close proximity to each other, i.e. in the primary or tertiary structure of the amino acid sequence) via which the amino acid sequence of the invention can bind to an envelope protein of a virus, which amino acid residues or stretches of amino acid residues thus form the "site" for binding to an envelope protein of a virus (also referred to herein as the "antigen binding site").

The amino acid sequences provided by the invention are preferably in essentially isolated form (as defined herein), or form part of a protein or polypeptide of the invention (as defined herein), which may comprise or essentially consist of one or more amino acid sequences of the invention and which may optionally further comprise one or more further amino acid sequences (all optionally linked via one or more suitable linkers). For example, and without limitation, the one or more amino acid sequences of the invention may be used as a binding unit in such a protein or polypeptide, which may optionally contain one or more further amino acid sequences that can serve as a binding unit (i.e. against one or more other targets than the envelope protein of a virus, to which the amino acid sequences of the invention specifically bind to and/or are directed against), so as to provide a monovalent, multivalent or multispecific polypeptide of the invention, respectively, all as described herein. Such a protein or polypeptide may also be in essentially isolated form (as defined herein).

The amino acid sequences and polypeptides of the invention as such preferably essentially consist of a single amino acid chain that is not linked via disulphide bridges to any other amino acid sequence or chain (but that may or may not contain one or more intramolecular disulphide bridges. For example, it is known that NANOBODIES® ($V_{HH}$ sequences)—as described herein—may sometimes contain a disulphide bridge between CDR3 and CDR1 or FR2). However, it should be noted that one or more amino acid sequences of the invention may be linked to each other and/or to other amino acid sequences (e.g. via disulphide bridges) to provide peptide constructs that may also be useful in the invention (for example Fab' fragments, $F(ab')_2$ fragments, ScFv constructs, "diabodies" and other multispecific constructs. Reference is for example made to the review by Holliger and Hudson, Nat Biotechnol. 2005 September; 23(9):1126-36).

Generally, when an amino acid sequence of the invention (or a compound, construct or polypeptide comprising the same) is intended for administration to a subject (for example for therapeutic and/or diagnostic purposes as described herein), it is preferably either an amino acid sequence that does not occur naturally in said subject; or, when it does occur naturally in said subject, in essentially isolated form (as defined herein).

It will also be clear to the skilled person that for pharmaceutical use, the amino acid sequences of the invention (as well as compounds, constructs and polypeptides comprising the same) are preferably directed against an envelope protein of a virus that is able to infect humans; whereas for veterinary purposes, the amino acid sequences and polypeptides of the invention are preferably directed against an envelope protein of a virus that is able to infect the species to be treated, or at least cross-reactive with an envelope protein of a virus that is able to infect the species to be treated.

Furthermore, an amino acid sequence of the invention may optionally, and in addition to the at least one binding site for binding against an envelope protein of a virus, contain one or more further binding sites for binding against other antigens, proteins or targets.

The efficacy of the amino acid sequences and polypeptides of the invention, and of compositions comprising the same, can be tested using any suitable in vitro assay, cell-based assay, in vivo assay and/or animal model known per se, or any combination thereof, depending on the specific disease or disorder involved. Suitable assays and animal models will be clear to the skilled person, and for example include a Biacore assay; epitope mapping e.g. by using monoclonal antibodies which recognize known epitopes; cell based neutralization assays for the different virus strains (e.g. virus neutralization assay for influenza as described in Vanlandschoot et al. *Virol.* 212: 526-534 (1995) and Vanlandschoot et al. J. Gen. Virol. 79: 1781-1791 (1998) or Rapid Fluorescent Focus Inhibition Test (RFFIT) for rabies as described in Standard procedure from WHO Laboratory Techniques in Rabies, (1996)); in vitro inhibition of cell to cell spread (Dietzschold et al. *J. Virol.* 56: 12-18 (1985)); cell-cell fusion inhibition assay (Vanlandschoot et al. J. Gen. Virol. 79: 1781-1791 (1998)); plaque assay to examine resistance or sensitivity to antibody (Vanlandschoot et al. J. Gen. Virol. 79: 1781-1791 (1998)); investigate ADEI in macrophage cell lines and primary macrophages and compare infection rates with and without preincubation of the virus with antibodies and amino acid sequences and polypeptides of the invention (Tirado et al. *Viral Immunol.* 16: 69-86 (2003)); retroviral and lentiviral pseudotypes of replication-competent virus to study neutralizing antibody responses to H5N1 viral infection (Temperton et al. Emerg. Infect. Dis. 11: 411-416 (2005)); cotton rat model for studies on RSV (Murphy et al. *Virus Res.* 11: 1-15 (1988)); in vivo screening of neutralizing capacity of rabies infection by intracerebral inoculation in mice; validation of the use of amino acid sequences and polypeptides according to the invention for post-exposure prophylaxis (Schumacher et al. *Vaccine* 10: 754-760 (1992)); assessment of the therapeutic potential of amino acid sequences and polypeptides of the invention to treat an ongoing viral brain infection; Ferret model for H5N1 infection (Yen et al. *J. Virol.* 81: 6890-6898 (2007)); assessment of the prophylactic and therapeutic potential of amino acid sequences and polypeptides of the invention to treat influenza-infected mice (Simmons et al. *Plos Medicine* 4 (5): 928-936); as well as the assays and animal models used in the experimental part below and in the prior art cited herein.

Also, according to the invention, amino acid sequences and polypeptides that are directed against an envelope protein of a virus that is able to infect a first species of warm-blooded animal may or may not show cross-reactivity with an envelope protein of a virus that is able to infect one or more other species of warm-blooded animal. For example, amino acid sequences and polypeptides directed against an envelope protein of a virus that is able to infect humans may or may not show cross reactivity with an envelope protein of a virus that is able to infect one or more other species of primates (such as, without limitation, monkeys from the genus *Macaca* (such as, and in particular, cynomolgus monkeys (*Macaca fascicularis*) and/or rhesus monkeys (*Macaca mulatta*)) and baboon (*Papio ursinus*)) and/or with an envelope protein of a virus that is able to infect one or more species of animals that are often used in animal models for diseases (for example mouse, rat, rabbit, pig or dog), and in particular in animal models for diseases and disorders associated with viral entry and/or viral replication and/or mediated by an envelope protein of a virus and/or its viral receptor (such as the species and animal models mentioned herein). In this respect, it will be clear to the skilled person that such cross-reactivity, when present, may have advantages from a drug development point of view, since it allows the amino acid sequences and polypeptides against an envelope protein of a virus that is able to infect humans to be tested in such disease models.

More generally, amino acid sequences and polypeptides of the invention that are cross-reactive with two or more homologous envelope proteins of a virus that is able to infect multiple species of mammal will usually be advantageous for use in veterinary applications, since it will allow the same amino acid sequence or polypeptide to be used across multiple species. Thus, it is also encompassed within the scope of the invention that amino acid sequences and polypeptides directed against an envelope protein of a virus that is able to infect one species of animal (such as amino acid sequences and polypeptides against an envelope protein of a virus that is able to infect humans) can be used in the treatment of another species of animal, as long as the use of the amino acid sequences and/or polypeptides provide the desired effects in the species to be treated.

The present invention is in its broadest sense also not particularly limited to or defined by a specific envelope protein of a virus or a specific class, category or type of envelope proteins of a virus against which the amino acid sequences and polypeptides of the invention are directed. For example, the amino acid sequences and polypeptides may be directed against any envelope protein of a virus. Virus envelope proteins are known in the art and for example include but are not limited to: the F protein of RSV virus, the G protein of RSV virus, the SH protein of RSV virus, the M protein of RSV virus, the M2 protein of RSV virus, the HA protein of influenza A virus, the gp120 protein of HIV-1 virus, the S1 protein of SARS Corona virus, the gD protein of Herpes simplex 1 virus, the HEF protein of influenza C virus, the 5 F protein of Simian parainfluenza virus, the F protein of Human parainfluenza virus, the F protein of Newcastle disease virus, the F2 protein of measles, the F2 protein of Sendai virus, the gp2 protein of Ebola virus, the TM protein of Moloney murine leukemia virus, the gp41 protein of Human immunodeficiency virus 1, the gp41 protein of Simian immunodeficiency virus, the gp21 protein of Human T cell leukemia virus 1, the TM protein of Human syncytin-2, the TM protein of Visna virus, the S2 protein of Mouse hepatitis virus, the E2 protein of SARS corona virus, the E protein of Tick-borne encephalitis virus, the E2 protein of Dengue 2 and 3 virus, the E protein of Yellow Fever virus, the E protein of West Nile virus, the E1 protein of Semliki forest virus, the E1 protein of Sindbis virus, the G protein of Rabies virus, the G protein of Vesicular stomatitis virus and the gB protein of Herpes simplex virus.

The amino acid sequences and polypeptides of the invention may be directed against any of the foregoing viral envelope proteins. Other examples of viral envelope proteins will be clear to the skilled person; for instance, the amino acid sequences and polypeptides according to the invention may be directed against any of the viral envelope proteins that are disclosed in the handbook "Fields Virology", 5$^{th}$ edition (2007) by David M. Knipe, PhD; Peter M. Howley, MD; Diane E. Griffin, MD, PhD; Robert A. Lamb, PhD, ScD; Malcolm A. Martin, MD; Bernard Roizman, ScD; Stephen E. Straus, MD (ISBN-10: 0781760607; ISBN-13: 9780781760607).

However, it is generally assumed and preferred that the amino acid sequences and polypeptides of the invention are preferably directed against an envelope protein of a virus, wherein said envelope protein is a viral attachment protein (as further defined herein); and/or a viral fusion protein (as further defined herein); and/or a viral attachment protein and a viral fusion protein (as further defined herein).

Thus, in one preferred, but non-limiting aspect, the amino acid sequences and polypeptides of the invention are directed against and/or specifically bind to an envelope protein of a virus, which is a viral attachment protein (as further defined herein). Viral attachment proteins are known in the art and for example include but are not limited to: the G protein of RSV virus, the HA protein of influenza A virus, the gp120 protein of HIV-1 virus, the S1 protein of SARS Corona virus, the gD protein of Herpes simplex 1 virus, the E protein of Tick-borne encephalitis virus, the E2 protein of Dengue 2 and 3 virus, the E protein of Yellow Fever virus, and the E protein of West Nile virus.

The amino acid sequences and polypeptides of the invention may be directed against any of the foregoing viral attachment proteins. Other examples of viral attachment proteins will be clear to the skilled person; for instance, the amino acid sequences and polypeptides according to the invention may be directed against any of the viral attachment proteins that are disclosed in the handbook "Fields Virology", 5$^{th}$ edition (2007) by David M. Knipe, PhD; Peter M. Howley, MD; Diane E. Griffin, MD, PhD; Robert A. Lamb, PhD, ScD; Malcolm A. Martin, MD; Bernard Roizman, ScD; Stephen E. Straus, MD (ISBN-10: 0781760607; ISBN-13: 9780781760607).

The structural and functional features and mechanisms of action of a variety of viral attachment proteins are known in the art and are for example described in detail in the following literature: "Fields Virology", 5$^{th}$ edition (2007) by David M. Knipe, PhD; Peter M. Howley, MD; Diane E. Griffin, MD, PhD; Robert A. Lamb, PhD, ScD; Malcolm A. Martin, MD; Bernard Roizman, ScD; Stephen E. Straus, MD (ISBN-10: 0781760607; ISBN-13: 9780781760607).

It is assumed to be understood that a particular functional viral attachment protein (as defined herein) can be expressed in its functional form or can be expressed in the form of a (non-active) precursor protein. In the case that said particular functional viral attachment protein is expressed as a (non-active) precursor protein, it may be post-translationally processed and/or modified (for example by cleavage with one or more enzymes, such as proteases) within the target host cell (as defined herein) of the virus (for instance in specialized organelles such as the trans-Golgi compartment), resulting in a functional attachment protein and optionally at least one other main protein moiety. After said functional attachment protein and optionally said at least one other main protein moiety have been formed, these may either remain attached to each other (such as via covalent bounds, for instance by one or more disulfide bridges, or via non-covalent bounds, for instance by forming a protein complex) or these may be separated from each other; in both cases however (remaining attached to each other or being separated from each other) either only the resulting functional attachment protein or both the resulting functional attachment protein and the optionally at least one other main protein moiety may be directly involved in the attachment process between the virion and its target host cell (as defined herein) (for instance by binding to a particular viral receptor that is expressed on the surface of said target host cell). However, it is preferred that only the resulting functional attachment protein is directly involved in the attachment process between the virion and its target host cell (for instance by binding to a particular viral receptor that is expressed on the surface of said target host cell). Examples of such functional attachment proteins that are formed by post-translational modification include but are not limited to the gp120 protein of HIV-1 virus and the HA1 protein of influenza. It is however not excluded that said formed at least one other main protein moiety is involved (either directly or indirectly) in the attachment process between the virion and its target host cell (as defined herein) and/or that said formed at least one other main protein moiety is involved (either directly or indirectly) in another process (such as for instance fusion of said virion with its target host cell) that is part of the process of infection and/or replication of said virion.

In another, non-limiting, preferred aspect, the amino acid sequences and polypeptides of the invention are directed against and/or specifically bind to an envelope protein of a virus, which is a viral fusion protein (as further defined herein).

Viral fusion proteins are known in the art and for example include but are not limited to: the F protein of RSV virus, the HA protein of Influenza A virus, the HEF protein of influenza C virus, the 5 F protein of Simian parainfluenza virus, the F protein of Human parainfluenza virus, the F protein of Newcastle disease virus, the F2 protein of measles, the F2 protein of Sendai virus, the gp2 protein of Ebola virus, the TM protein of Moloney murine leukemia virus, the gp41 protein of Human immunodeficiency virus 1, the gp41 protein of Simian immunodeficiency virus, the gp21 protein of Human T cell leukemia virus 1, the TM protein of Human syncytin-2, the TM protein of Visna virus, the S2 protein of Mouse hepatitis virus, the E2 protein of SARS corona virus, the E protein of Tick-borne encephalitis virus, the E2 protein of Dengue 2 and 3 virus, the E protein of Yellow Fever virus, the E protein of West Nile virus, the E1 protein of Semliki forest virus, the E1 protein of Sindbis virus, the G protein of Rabies virus, the G protein of Vesicular stomatitis virus and the gB protein of Herpes simplex virus.

The amino acid sequences and polypeptides of the invention may be directed against any of the foregoing viral fusion proteins. Other examples of viral fusion proteins will be clear to the skilled person; for instance, the amino acid sequences and polypeptides according to the invention may be directed against any of the viral fusion proteins that are disclosed in the handbook "Fields Virology", $5^{th}$ edition (2007) by David M. Knipe, PhD; Peter M. Howley, MD; Diane E. Griffin, MD, PhD; Robert A. Lamb, PhD, ScD; Malcolm A. Martin, MD; Bernard Roizman, ScD; Stephen E. Straus, MD (ISBN-10: 0781760607; ISBN-13: 9780781760607).

The structural and functional features and mechanisms of action of a variety of viral fusion proteins are known in the art and are for example described in detail in the following literature: Baker et al. *Mol. Cell* 3: 309-319 (1999); Chen et al. *Proc. Natl. Acad. Sci. USA* 96: 8967-8972 (1999); Earp et al. *Curr. Topics Microbiol. Immunol.* 285, 25-66 (2005); Heldwein et al. *Science* 313: 217-220 (2006); Helenius et al. *J. Cell Biol.* 84, 404-420 (1980); Kielian et al. *Nat. Rev. Microbiol.* 4: 67-76 (2006); Lescar et al. Cell 105: 137-148 (2001); Modis Proc. Natl. Acad. Sci. USA 100: 6986-6991 (2003); Moore and Doms *Proc. Natl. Acad. Sci. USA.* 100: 10598-10602 (2003); Rey 375: 291-298 (1995); Roche et al. *Science* 313: 187-191 (2006); Sieczkarski et al. *Curr. Topics Microbiol. Immunol.* 285, 1-23 (2005); Smith et al. *Science* 304, 237-242 (2004); Skehel et al. *Cell* 95: 871-874 (1998); Weissenhorn et al. *FEBS Lett.* 581, 2150-2155 (2007); Wilson et al. *Nature* 289: 366-373 (1981) and Yin et al. *Proc. Natl. Acad. Sci. USA* 102: 9288-9293 (2005); Handbook "Fields Virology", $5^{th}$ edition (2007) by David M. Knipe, PhD; Peter M. Howley, MD; Diane E. Griffin, MD, PhD; Robert A. Lamb, PhD, ScD; Malcolm A. Martin, MD; Bernard Roizman, ScD; Stephen E. Straus, MD (ISBN-10: 0781760607; ISBN-13: 9780781760607).

It is assumed to be understood that a particular functional viral fusion protein (as defined herein) can be expressed in its functional form or can be expressed in the form of a (non-active) precursor protein. In the case that said particular functional viral fusion protein is expressed as a (non-active) precursor protein, it may be post-translationally processed and/or modified (for example by cleavage with one or more enzymes, such as proteases) within the target host cell (as defined herein) of the virus (for instance in specialized organelles such as the trans-Golgi compartment), resulting in a functional fusion protein and optionally at least one other main protein moiety. After said functional fusion protein and optionally said at least one other main protein moiety have been formed, these may either remain attached to each other (such as via covalent bounds, for instance by one or more disulfide bridges, or via non-covalent bounds, for instance by forming a protein complex) or these may be separated from each other; in both cases however (remaining attached to each other or being separated from each other) either only the resulting functional fusion protein or both the resulting functional fusion protein and the optionally at least one other main protein moiety may be directly involved in the fusion process between the virion and its target host cell (as defined herein) (for instance by binding to membrane components of said target host cell). However, it is preferred that only the resulting functional fusion protein is directly involved in the fusion process between the virion and its target host cell (for instance by binding to membrane components of said target host cell). Examples of such functional fusion proteins that are formed by post-translational modification include but are not limited to the gp41 protein of HIV-1 virus and the HA2 subunit of HA protein of influenza. It is however not excluded that said at least one other main protein moiety is involved (either directly or indirectly) in the fusion process between the virion and its target host cell and/or that said at least one other main protein moiety is involved (either directly or indirectly) in another process (such as for instance attachment of said virion to its target host cell) that is part of the process of infection and/or replication of said virion.

Also, in another preferred, but non-limiting aspect, the amino acid sequences and polypeptides of the invention are directed against and/or specifically bind to an envelope protein of a virus, which is a viral attachment protein and a viral fusion protein (as further defined herein).

Viral envelope proteins that are both viral attachment proteins and viral fusion proteins are known in the art and for example include but are not limited to: the HA protein of influenza A virus, the E2 protein of SARS corona virus, the E protein of Tick-borne encephalitis virus, the E2 protein of Dengue 2 and 3 virus, the E protein of Yellow Fever virus, the E protein of West Nile virus, the E1 protein of Semliki forest virus, and the E1 protein of Sindbis virus. The amino acid sequences and polypeptides of the invention may be directed against any of the foregoing viral envelope proteins that are both viral attachment proteins and viral fusion proteins. Other examples of viral envelope proteins that are both viral attachment proteins and viral fusion proteins will be clear to the skilled person; for instance, the amino acid sequences and polypeptides according to the invention may be directed against any of the viral envelope proteins that are both viral attachment proteins and viral fusion proteins and are disclosed in the handbook "Fields Virology", $5^{th}$ edition (2007) by David M. Knipe, PhD; Peter M. Howley, MD; Diane E. Griffin, MD, PhD; Robert A. Lamb, PhD, ScD; Malcolm A. Martin, MD; Bernard Roizman, ScD; Stephen E. Straus, MD (ISBN-10: 0781760607; ISBN-13: 9780781760607).

The structural and functional features and mechanisms of action of a variety of envelope proteins that are both viral attachment proteins and viral fusion proteins are known in the art and are for example described in detail in the following literature: handbook "Fields Virology", $5^{th}$ edition (2007) by David M. Knipe, PhD; Peter M. Howley, MD; Diane E. Griffin, MD, PhD; Robert A. Lamb, PhD, ScD; Malcolm A. Martin, MD; Bernard Roizman, ScD; Stephen E. Straus, MD (ISBN-10: 0781760607; ISBN-13: 9780781760607).

A particular functional viral envelope protein, which is both an attachment and a fusion protein, can be expressed in its functional form or can be expressed in the form of a (non-active) precursor protein. In the case that said particular functional viral attachment and fusion protein is expressed as a (non-active) precursor protein, it may be post-translationally processed and/or modified (for example by cleavage with one or more enzymes, such as proteases) within the target host cell (as defined herein) of the virus (for instance in specialized organelles such as the trans-Golgi compartment), resulting in a functional viral attachment and fusion protein and optionally at least one other main protein moiety. After said functional viral attachment and fusion protein and optionally said at least one other main protein moiety have been formed, these may either remain attached to each other (such as via covalent bounds, for instance by one or more disulfide bridges, or via non-covalent bounds, for instance by forming a protein complex) or these may be separated from each other; in both cases however (remaining attached to each other or being separated from each other) either only the resulting functional viral attachment and fusion protein or both the resulting functional viral attachment and fusion protein and the optionally at least one other main protein moiety may be directly involved in the fusion process between the virion and its target host cell (for instance by binding to a particular viral receptor that is expressed on the surface of said target host cell and/or to membrane components of said target host cell). However, it is preferred that only the resulting functional viral attachment and fusion protein is directly involved in the fusion process between the virion and its target host cell (for instance by binding to a particular viral receptor that is expressed on the surface of said target host cell and/or to membrane components of said target host cell). It is however not excluded that said at least one other main protein moiety is involved (either directly or indirectly) in the fusion process between the virion and its target host cell (as defined herein) and/or that said at least one other main protein moiety is involved (either directly or indirectly) in another process (such as for instance only attachment of said virion to its target host cell or only fusion of said virion with its target host cell) that is part of the process of infection and/or replication of said virion.

The present invention is not particularly limited to or defined by a specific conformation and/or secondary and/or tertiary and/or quaternary structure of said envelope protein against which the amino acid sequences and polypeptides of the invention are directed. Thus, said envelope protein may be characterized by any conformation and/or secondary and/or tertiary and/or quaternary structure. For example, when an envelope protein of a virus exists in an activated conformation and in an inactive conformation or in a pre-fusion and post-fusion conformation or state, the amino acid sequences and polypeptides of the invention may bind to either one of these conformations, or may bind to both these conformations (i.e. with an affinity and/or specificity which may be the same or different).

Also, for example, the amino acid sequences and polypeptides of the invention may bind to a conformation of an envelope protein of a virus in which it is bound to a binding partner (as further defined herein), may bind to a conformation of an envelope protein of a virus in which it not bound to a binding partner, or may bind to both such conformations (again with an affinity and/or specificity which may be the same or different).

More specifically, said envelope protein may be characterized by a pre-fusion conformational state (as further defined herein) and/or an intermediate conformational state (as further defined herein) and/or a post-fusion conformational state (as further defined herein). In particular, said envelope protein, which is characterized by a pre-fusion conformational state and/or an intermediate conformational state and/or a post-fusion conformational state may be a viral attachment protein; alternatively and more preferably, said envelope protein, which is characterized by a pre-fusion conformational state and/or an intermediate conformational state and/or a post-fusion conformational state may be a viral fusion protein (as defined herein); also, said envelope protein, which is characterized by a pre-fusion conformational state and/or an intermediate conformational state and/or a post-fusion conformational state may be a viral attachment protein and a viral fusion protein.

In cases wherein said at least one fusion protein is characterized by a pre-fusion conformational state, said pre-fusion conformational state may be a fusion protein trimer, such as for example (but not limited to) a trimer of hairpins or a six-helix bundle. When said pre-fusion conformational state of a viral fusion protein is a fusion protein trimer, three protein subunits are comprised in said protein trimer, which are preferably identical but also may be different from each other. Also, a particular protein subunit of said fusion protein trimer can either remain intact or uncleaved before, during and after the fusion process between a virion and its target host cell (as defined herein) or can be cleaved (for instance by one or more enzymes, such as proteases) before, during or after the fusion process to form at least two main protein moieties originating from said subunit of said protein trimer. In the case that said protein subunit of said fusion protein trimer is cleaved as described above, said at least two main protein moieties can either stay attached to each other (such as via covalent bounds, for instance by one or more disulfide bridges, or non-covalent bounds, for instance by forming a protein complex) or can be completely separate protein moieties, originating from the same subunit; in both cases however, either staying attached to each other or being completely separated from each other, it may be that only one, or at least two, or two or more or all of said main proteins moieties (originating from the same subunit of said fusion protein trimer) are directly involved in the fusion process between a virion and its target host cell (as defined herein). However, preferably, only one of said main proteins moieties (originating from the same subunit of said fusion protein trimer) is directly involved in the fusion process between a virion and its target host cell (as defined herein). Examples of such main protein parts that are directly involved in the fusion process between a virion and its target host cell include but are not limited to the F2 protein of RSV virus and the HA2 subunit of HA protein of influenza virus.

Examples of viral fusion proteins that are characterized by a pre-fusion conformational state, which is a fusion protein trimer, such as for example a trimer of hairpins or a six-helix bundle include but are not limited to Influenza A virus HA protein, Influenza C virus HEF protein, Simian parainfluenza virus 5 F protein, Human parainfluenza virus F protein, Newcastle disease virus F protein, Respiratory syncytial virus F protein, Measles F2 protein, Sendai F2 protein, Ebola virus gp2 protein, Moloney murine leukemia virus TM protein, Human immunodeficiency virus 1 gp41 protein, Simian immunodeficiency virus gp41 protein, Human T cell leukemia virus 1 gp21 protein, Human syncytin-2 TM protein, Visna virus TM protein, Mouse hepatitis virus S2 protein and SARS corona virus E2 protein.

Alternatively, said viral fusion protein may be characterized by a pre-fusion conformational state (as defined herein), wherein said pre-fusion conformational state is a protein dimer (comprising two protein subunits), such as for example a fusion protein homodimer (comprising two identical protein subunits) or a protein heterodimer (comprising two different protein subunits). It is assumed to be understood that when said pre-fusion conformational state of a viral fusion protein is a protein dimer, such as a fusion protein homodimer or a protein heterodimer, that in said protein dimer (comprising two protein subunits) either both or only one of the two protein subunits of said protein dimer can be directly involved in the fusion process between a virion and its target host cell (as defined herein). Also, it is assumed to be understood that the two protein subunits of said protein dimer can either be attached to each other (such as for instance via covalent bounds or non-covalent bounds) or can be cleaved (for instance by one or more enzymes, such as proteases) to form two separate protein monomers before, during or after the fusion process between a virion and its target host cell.

Finally, said viral fusion protein may be characterized by a pre-fusion conformational state (as defined herein), wherein said pre-fusion conformational state is a fusion protein monomer.

Examples of viral fusion proteins that are characterized by a pre-fusion conformational state, which is a protein dimer, such as a fusion protein homodimer or a protein heterodimer, or a protein monomer include but are not limited to Tick-borne encephalitis virus E protein, Dengue 2 and 3 virus E2 protein, yellow fever E protein, West Nile virus E protein, Semliki forest virus E1 protein and Sindbis E1 protein.

In cases wherein said at least one fusion protein is characterized by a post-fusion conformational state, said post-fusion conformational state may be a fusion protein trimer, such as for example (but not limited to) a trimer of hairpins or a six-helix bundle. More specifically, said post-fusion conformational state of viral fusion proteins may be a fusion protein trimer, which comprises an α-helical coiled coil and/or β-structures and/or an α-helical coiled coil and β-structures.

Examples of viral fusion proteins that are characterized by a post-fusion conformational state, which is a trimer of hairpins comprising an α-helical coiled coil include but are not limited to Influenza A virus HA protein, Influenza C virus HEF protein, Simian parainfluenza virus 5 F protein, Human parainfluenza virus F protein, Newcastle disease virus F protein, Human respiratory syncytial virus F protein, Measles F2 protein, Sendai F2 protein, Ebola virus gp2 protein, Moloney murine leukemia virus TM protein, Human immunodeficiency virus 1 gp41 protein, Simian immunodeficiency virus gp41 protein, Human T cell leukemia virus 1 gp21 protein, Human syncytin-2 TM protein, Visna virus TM protein, Mouse hepatitis virus S2 protein and SARS corona virus E2 protein.

Examples of viral fusion proteins that are characterized by a post-fusion conformational state, which is a trimer of hairpins comprising β-structures include but are not limited to Tick-borne encephalitis virus E protein, Dengue 2 and 3 virus E2 protein, yellow fever E protein, West Nile virus E protein, Semliki forest virus E1 protein and Sindbis E1 protein.

Examples of viral fusion proteins that are characterized by a post-fusion conformational state, which is a trimer of hairpins comprising an α-helical coiled coil and β-structures include but are not limited to vesicular stomatitis virus G protein, rabies G protein and Herpes simplex virus gB protein.

The present invention thus generally provides amino acid sequences and polypeptides that may be directed to and/or may specifically bind to any conformation and/or secondary and/or tertiary and/or quaternary structure (where applicable) of said envelope protein.

In a first specific aspect, the present invention provides amino acid sequences and polypeptides that are directed to and/or specifically bind to the pre-fusion conformational state (as defined herein) of an envelope protein, which is a viral attachment protein (as defined herein), such as for example (but not limited to) amino acid sequences and polypeptides that are directed to and/or specifically bind to the pre-fusion conformational state of a viral attachment protein, wherein said pre-fusion conformational state is characterized by a trimer of hairpins or a six-helical bundle; also, the present invention provides amino acid sequences and polypeptides that are directed to and/or specifically bind to the intermediate conformational state (as defined herein) of an envelope protein, which is a viral attachment protein; finally, the present invention provides amino acid sequences and polypeptides that are directed to and/or specifically bind to the post-fusion conformational state (as defined herein) of an envelope protein, which is a viral attachment protein, such as for example (but not limited to) amino acid sequences and polypeptides that are directed to and/or specifically bind to the post-fusion conformational state of a viral attachment protein, wherein said post-fusion conformational state is characterized by a trimer of hairpins comprising an α-helical coiled coil or comprising an α-helical coiled coil and β-structures.

In this aspect of the invention, it is also encompassed that the amino acid sequences and polypeptides can be directed to and/or can specifically bind to the pre-fusion conformational state and to the intermediate conformational state of said viral attachment protein; also, the amino acid sequences and polypeptides of the invention can be directed to and/or can specifically bind to the pre-fusion conformational state and to the post-fusion conformational state of said viral attachment protein; furthermore, the amino acid sequences and polypeptides of the invention can be directed to and/or can specifically bind to the intermediate conformational state and to the post-fusion conformational state of said viral attachment protein.

Furthermore, it is encompassed in this specific aspect of the present invention that the amino acid sequences and polypeptides can be directed to and/or can specifically bind to the pre-fusion conformational state and to the intermediate conformational state and to the post-fusion conformational state of said viral attachment protein.

In a second specific and preferable aspect, the present invention provides amino acid sequences and polypeptides that are directed to and/or specifically bind to the pre-fusion conformational state (as defined herein) of an envelope protein, which is a viral fusion protein (as defined herein), such as for example (but not limited to) amino acid sequences and polypeptides that are directed to and/or specifically bind to the pre-fusion conformational state of a viral fusion protein, wherein said pre-fusion conformational state is characterized by a trimer of hairpins or a six-helical bundle; also, the present invention provides amino acid sequences and polypeptides that are directed to and/or specifically bind to the intermediate conformational state (as defined herein) of an envelope protein, which is a viral fusion protein; finally, the present invention provides amino acid sequences and polypeptides that are directed to and/or specifically bind to the post-fusion conformational state (as defined herein) of an envelope protein, which is a viral fusion protein, such as for example (but not limited to) amino acid sequences and polypeptides that are directed to and/or specifically bind to the post-fusion conformational state of a viral fusion protein, wherein said post-fusion conformational state is characterized by a trimer of hairpins comprising an α-helical coiled coil or comprising an α-helical coiled coil and β-structures.

In this aspect of the invention, it is also encompassed that the amino acid sequences and polypeptides can be directed to and/or can specifically bind to the pre-fusion conformational state and to the intermediate conformational state of said viral fusion protein; also, the amino acid sequences and polypeptides of the invention can be directed to and/or can specifically bind to the pre-fusion conformational state and to the post-fusion conformational state of said viral fusion protein; furthermore, the amino acid sequences and polypeptides of the invention can be directed to and/or can specifically bind to the intermediate conformational state and to the post-fusion conformational state of said viral fusion protein.

Furthermore, it is encompassed in this specific aspect of the present invention that the amino acid sequences and polypeptides can be directed to and/or can specifically bind to the pre-fusion conformational state and to the intermediate conformational state and to the post-fusion conformational state of said viral fusion protein.

In a third specific aspect, the present invention provides amino acid sequences and polypeptides that are directed to and/or specifically bind to the pre-fusion conformational state (as defined herein) of an envelope protein, which is both a viral attachment protein and a viral fusion protein (as defined herein), such as for example (but not limited to) amino acid sequences and polypeptides that are directed to and/or specifically bind to the pre-fusion conformational state of an envelope protein, which is both a viral attachment protein and a viral fusion protein, wherein said pre-fusion conformational state is characterized by a trimer of hairpins or a six-helical bundle; also, the present invention provides amino acid sequences and polypeptides that are directed to and/or specifically bind to the intermediate conformational state (as defined herein) of an envelope protein, which is both a viral attachment protein and a viral fusion protein; finally, the present invention provides amino acid sequences and polypeptides that are directed to and/or specifically bind to the post-fusion conformational state (as defined herein) of an envelope protein, which is both a viral attachment protein and a viral fusion protein, such as for example (but not limited to) amino acid sequences and polypeptides that are directed to and/or specifically bind to the post-fusion conformational state of an envelope protein, which is both a viral attachment protein and a viral fusion protein, wherein said post-fusion conformational state is characterized by a trimer of hairpins comprising an α-helical coiled coil or comprising an α-helical coiled coil and β-structures.

In this aspect of the invention, it is also encompassed that the amino acid sequences and polypeptides can be directed to and/or can specifically bind to the pre-fusion conformational state and to the intermediate conformational state of said envelope protein, which is both a viral attachment protein and a viral fusion protein; also, the amino acid sequences and polypeptides of the invention can be directed to and/or can specifically bind to the pre-fusion conformational state and to the post-fusion conformational state of said envelope protein, which is both a viral attachment protein and a viral fusion protein; furthermore, the amino acid sequences and polypeptides of the invention can be directed to and/or can specifically bind to the intermediate conformational state and to the post-fusion conformational state of said envelope protein, which is both a viral attachment protein and a viral fusion protein.

Furthermore, it is encompassed in this specific aspect of the present invention that the amino acid sequences and polypeptides can be directed to and/or can specifically bind to the pre-fusion conformational state and to the intermediate conformational state and to the post-fusion conformational state of said envelope protein, which is both a viral attachment protein and a viral fusion protein.

As further described herein, a polypeptide of the invention may be bivalent and/or multivalent (as defined herein) and contain two or more amino acid sequences of the invention that are directed against an envelope protein of a virus. Generally, such polypeptides will bind to an envelope protein of a virus with increased avidity compared to a single amino acid sequence of the invention. It has also been observed that such polypeptides show (synergistically) increased binding, competition, and/or in vitro and/or in vivo neutralization of different genotypes, subtypes, escape mutants and/or strains of a virus.

Such a polypeptide may for example comprise two amino acid sequences of the invention that are directed against the same antigenic determinant, epitope, part, domain, subunit or conformation (where applicable) of an envelope protein of a virus (which may or may not be an interaction site); or such a polypeptide may be biparatopic and/or multiparatopic (as defined herein) and comprise at least one "first" amino acid sequence of the invention that is directed against a first antigenic determinant, epitope, part, domain, subunit or conformation (where applicable) of an envelope protein of a virus (which may or may not be an interaction site); and at least one "second" amino acid sequence of the invention that is directed against a second antigenic determinant, epitope, part, domain, subunit or conformation (where applicable) of said envelope protein of a virus, wherein said second antigenic determinant, epitope, part, domain, subunit or conformation is different from the first (and again may or may not be an interaction site). Preferably, in such "bi- and/or multiparatopic" polypeptides of the invention, at least one amino acid sequence of the invention is directed against an interaction site (as defined herein), although the invention in its broadest sense is not limited thereto.

It is thus also within the scope of the invention that, where applicable, a polypeptide of the invention can bind to two or more antigenic determinants, epitopes, parts, domains, subunits or conformations of an envelope protein of a virus. In such a case, the antigenic determinants, epitopes, parts, domains or subunits of said envelope protein of a virus to which the amino acid sequences and/or polypeptides of the invention bind may be essentially the same (for example, if an envelope protein of a virus contains repeated structural motifs or occurs in a multimeric form) or may be different (and in the latter case, the amino acid sequences and polypeptides of the invention are said to be "bi- and/or multiparatopic" and may bind to such different antigenic determinants, epitopes, parts, domains, subunits of said envelope protein of a virus with an affinity and/or specificity which may be the same or different) . Accordingly, bi- or multiparatopic polypeptides of the present invention are directed against and/or specifically bind to at least two epitopes of an envelope protein of a virus, and are for example (but not limited to) polypeptides that are directed against and/or can specifically bind to three or even more epitopes of the same envelope protein of a virus.

For example, and generally, a bivalent polypeptide of the invention may comprise two amino acid sequences of the invention directed against an antigenic determinant, epitope, part or domain of the viral envelope protein which may be suitably linked, for example via a suitable linker as further described herein. Preferably, such a bivalent polypeptide of the invention is further such that, when it binds to the viral envelope protein, it is capable of simultaneously binding to both antigenic determinants, epitopes, parts or domains (i.e. via the two amino acid sequences of the invention capable of binding to said antigenic determinants, epitopes, parts or domains). Examples of such bivalent polypeptides of the invention will become clear from the further description herein. Also, a trivalent polypeptide of the invention may comprise three amino acid sequences of the invention directed against an antigenic determinant, epitope, part or domain of the viral envelope protein, and generally multivalent polypeptides of the invention may contain at least two amino acid sequences of the invention directed against an antigenic determinants, epitopes, parts or domains of the viral envelope protein. Generally, such bivalent, trivalent and multivalent polypeptides of the invention may be as further described herein, and the various preferred aspects of the invention as described herein also apply to these bivalent, trivalent and multivalent polypeptides of the invention (for example, these bivalent, trivalent and multivalent polypeptides of the invention preferably comprise single variable domains and more preferably NANOBODIES® ($V_{HH}$ sequences)).

In one aspect of the invention, the amino acid sequences and (in particular) polypeptides of the invention are capable of binding to two or more antigenic determinants, epitopes, parts, domains of an envelope protein of a virus which are essentially the same. In this context, the amino acid sequences and polypeptides of the invention are also referred to as "multivalent (monospecific)" (such as e.g. "bivalent (monospecific)" or "trivalent (monospecific)", etc.) amino acid sequences and polypeptides. The multivalent amino acid sequences and polypeptides of the invention can be directed against any antigenic determinants, epitopes, parts, and/or domains of the envelope protein of a virus.

In a preferred, but non-limiting aspect, the amino acid sequences and (in particular) polypeptides of the invention bivalent and are directed against the Synagis® binding site on the RSV F protein and/or capable of competing with Synagis® for binding to the RSV F protein. The amino acid sequences and polypeptides of the invention may be directed against antigenic site II (also referred to as site A) of the RSV F protein as well as against at least one other antigenic determinant, epitope, part or domain on the RSV F protein. In a preferred aspect, the amino acid sequences and polypeptides of the invention are directed against region aa 250-275 of the RSV F protein as well as against at least one other antigenic determinant, epitope, part or domain on the RSV F protein.

Generally, such a bivalent polypeptide of the invention may contain two amino acid sequences of the invention that are capable of binding to the Synagis® binding site on the RSV F protein and/or capable of competing with Synagis® for binding to the RSV F protein (and in particular against antigenic site II (also referred to as site A) of the RSV F protein and more preferably against region aa 250-275 of the RSV F protein). Generally, such bivalent polypeptides of the invention may be as further described herein, and the various preferred aspects of the invention as described herein also apply to these bivalent polypeptides of the invention (for example, these bivalent polypeptides of the invention may comprise suitable linkers; are preferably such that they can simultaneously bind the Synagis® binding site; and preferably comprise single variable domains and more preferably NANOBODIES® ($V_{HH}$ sequences)).

In another preferred, but non-limiting aspect, the amino acid sequences and (in particular) polypeptides of the invention are bivalent and are at least capable, upon binding to the RSV F protein, to neutralize a virus (as defined herein); to modulate, reduce and/or inhibit the infectivity of a virus (as defined herein); to modulate and in particular inhibit and/or prevent viral entry (as further defined herein) in a target host cell; and/or to modulate and in particular inhibit and/or prevent viral replication (as further defined herein) in a target host cell via the same mechanism of action as Synagis®.

In another preferred, but non-limiting aspect, the amino acid sequences and polypeptides of the invention are bivalent and are directed against the 101F binding site on the RSV F protein and/or capable of competing with 101F for binding to the RSV F protein, The amino acid sequences and polypeptides of the invention may be directed against antigenic site IV-VI of the RSV F protein as well as against at least one other antigenic determinant on the RSV F protein. In a preferred aspect, the amino acid sequences and polypeptides of the invention are directed against region aa 423-436 of the RSV F protein as well as against at least one other antigenic determinant on the RSV F protein.

Generally, such a bivalent polypeptide of the invention will contain two amino acid sequences of the invention that are capable of binding to the 101F binding site on the RSV F protein and/or capable of competing with 101F for binding to the RSV F protein (and in particular against antigenic site IV-VI of the RSV F protein and more preferably against region aa 423-436 of the RSV F protein). Generally, such bivalent polypeptides of the invention may be as further described herein, and the various preferred aspects of the invention as described herein also apply to these bivalent polypeptides of the invention (for example, these bivalent polypeptides of the invention may comprise suitable linkers; are preferably such that they can simultaneously bind the 101F binding site; and preferably comprise single variable domains and more preferably NANOBODIES® ($V_{HH}$ sequences)).

In another preferred, but non-limiting aspect, the amino acid sequences and (in particular) polypeptides of the invention are bivalent and are at least capable, upon binding to the RSV F protein, to neutralize a virus (as defined herein); to modulate, reduce and/or inhibit the infectivity of a virus (as defined herein); to modulate and in particular inhibit and/or prevent viral entry (as further defined herein) in a target host cell; and/or to modulate and in particular inhibit and/or prevent viral replication (as further defined herein) in a target host cell via the same mechanism of action as 101F.

In another preferred, but non-limiting aspect, the amino acid sequences and (in particular) polypeptides of the invention are bivalent and are directed against the sialic acid binding site on the hemagglutinin H5 envelope protein of influenza virus and/or capable of competing with sialic acid for binding to the hemagglutinin H5 envelope protein of influenza virus.

Generally, such a bivalent polypeptide of the invention will contain two amino acid sequences of the invention that are capable of binding to the sialic acid binding site on the hemagglutinin H5 envelope protein of influenza virus and/or capable of competing with sialic acid for binding to the hemagglutinin H5 envelope protein of influenza virus. Generally, such bivalent polypeptides of the invention may be as further described herein, and the various preferred aspects of the invention as described herein also apply to these bivalent polypeptides of the invention (for example, these bivalent polypeptides of the invention may comprise suitable linkers; are preferably such that they can simultaneously bind the sialic acid binding site; and preferably comprise single variable domains and more preferably NANOBODIES® ($V_{HH}$ sequences)).

In another preferred, but non-limiting aspect, the amino acid sequences and (in particular) polypeptides of the invention are bivalent and are directed against the VN04-2 binding site on the hemagglutinin H5 envelope protein of influenza virus and/or capable of competing with VN04-2 for binding to the hemagglutinin H5 envelope protein of influenza virus.

Generally, such a bivalent polypeptide of the invention will contain two amino acid sequences of the invention that are capable of binding to the VN04-2 binding site on the hemagglutinin H5 envelope protein of influenza virus and/or capable of competing with VN04-2 for binding to the hemagglutinin H5 envelope protein of influenza virus. Generally, such bivalent polypeptides of the invention may be as further described herein, and the various preferred aspects of the invention as described herein also apply to these bivalent polypeptides of the invention (for example, these bivalent polypeptides of the invention may comprise suitable linkers; are preferably such that they can simultaneously bind the VN04-2 binding site; and preferably comprise single variable domains and more preferably NANOBODIES® ($V_{HH}$ sequences)).

In another preferred, but non-limiting aspect, the amino acid sequences and (in particular) polypeptides of the invention are bivalent and are at least capable, upon binding to the hemagglutinin H5 envelope protein of influenza virus, to neutralize a virus (as defined herein); to modulate, reduce and/or inhibit the infectivity of a virus (as defined herein); to modulate and in particular inhibit and/or prevent viral entry (as further defined herein) in a target host cell; and/or to modulate and in particular inhibit and/or prevent viral replication (as further defined herein) in a target host cell via the same mechanism of action as VN04-2.

In another preferred, but non-limiting aspect, the amino acid sequences and (in particular) polypeptides of the invention are bivalent and are directed against the MAb C179 binding site on the hemagglutinin H5 envelope protein of influenza virus and/or capable of competing with MAb C179 for binding to the hemagglutinin H5 envelope protein of influenza virus.

Generally, such a bivalent polypeptide of the invention will contain two amino acid sequences of the invention that are capable of binding to the MAb C179 binding site on the hemagglutinin H5 envelope protein of influenza virus and/or capable of competing with MAb C179 for binding to the hemagglutinin H5 envelope protein of influenza virus. Generally, such bivalent polypeptides of the invention may be as further described herein, and the various preferred aspects of the invention as described herein also apply to these bivalent polypeptides of the invention (for example, these bivalent polypeptides of the invention may comprise suitable linkers; are preferably such that they can simultaneously bind the MAb C179 binding site; and preferably comprise single variable domains and more preferably NANOBODIES® ($V_{HH}$ sequences)).

In another preferred, but non-limiting aspect, the amino acid sequences and (in particular) polypeptides of the invention are bivalent and are at least capable, upon binding to the hemagglutinin H5 envelope protein of influenza virus, to neutralize a virus (as defined herein); to modulate, reduce and/or inhibit the infectivity of a virus (as defined herein); to modulate and in particular inhibit and/or prevent viral entry (as further defined herein) in a target host cell; and/or to modulate and in particular inhibit and/or prevent viral replication (as further defined herein) in a target host cell via the same mechanism of action as MAb C179.

In another preferred, but non-limiting aspect, the amino acid sequences and (in particular) polypeptides of the invention are bivalent and are directed against the mAb 8-2 binding site (and preferably against an epitope located in the antigenic site IIa) on the G envelope protein of rabies and/or capable of competing with mAb 8-2 for binding to the G envelope protein.

Generally, such a bivalent polypeptide of the invention will contain two amino acid sequences of the invention that are capable of binding to the mAb 8-2 binding site (and preferably an epitope located in the antigenic site IIa) on the G envelope protein and/or capable of competing with mAb 8-2 for binding to the G envelope protein. Generally, such bivalent polypeptides of the invention may be as further described herein, and the various preferred aspects of the invention as described herein also apply to these bivalent polypeptides of the invention (for example, these bivalent polypeptides of the invention may comprise suitable linkers; are preferably such that they can simultaneously bind the mAb 8-2 binding site; and preferably comprise single variable domains and more preferably NANOBODIES® ($V_{HH}$ sequences)).

In another preferred, but non-limiting aspect, the amino acid sequences and (in particular) polypeptides of the invention are bivalent and are at least capable, upon binding to the G envelope protein, to neutralize a virus (as defined herein); to modulate, reduce and/or inhibit the infectivity of a virus (as defined herein); to modulate and in particular inhibit and/or prevent viral entry (as further defined herein) in a target host cell; and/or to modulate and in particular inhibit and/or prevent viral replication (as further defined herein) in a target host cell via the same mechanism of action as MAb 8-2.

In a preferred aspect, the amino acid sequences and (in particular) polypeptides of the invention are capable of binding to two or more different antigenic determinants, epitopes, parts, domains of an envelope protein of a virus. In this context, the amino acid sequences and polypeptides of the invention are also referred to as "multiparatopic" (such as e.g. "biparatopic" or "triparatopic", etc.) amino acid sequences and polypeptides. The multiparatopic amino acid sequences and polypeptides of the invention can be directed against any antigenic determinants, epitopes, parts, and/or domains of the envelope protein of a virus.

For example, and generally, a biparatopic polypeptide of the invention may comprise at least one amino acid sequence of the invention directed against a first antigenic determinant, epitope, part or domain of the viral envelope protein and at least one amino acid sequence of the invention directed against a second antigenic determinant, epitope, part or domain of the viral envelope protein different from the first antigenic determinant, epitope, part or domain (in which said amino acid sequences may be suitably linked, for example via a suitable linker as further described herein). Preferably, such a biparatopic polypeptide of the invention is further such that, when it binds to the viral envelope protein, it is capable of simultaneously binding to the first antigenic determinant, epitope, part or domain (i.e. via the at least one amino acid sequence of the invention capable of binding to said first antigenic determinant, epitope, part or domain) and binding to said second antigenic determinant, epitope, part or domain (i.e. via the at least one amino acid sequence of the invention capable of binding to said second antigenic determinant, epitope, part or domain). Examples of such biparatopic polypeptides of the invention will become clear from the further description herein. Also, a triparatopic polypeptide of the invention may comprise at least one further amino acid sequence of the invention directed against a third antigenic determinant, epitope, part or domain of the viral envelope protein (different from both the first and second antigenic determinant, epitope, part or domain), and generally multiparatopic polypeptides of the invention may contain at least two amino acid sequences of the invention directed against at least two different antigenic determinants, epitopes, parts or domains of the viral envelope protein. Generally, such biparatopic, triparatopic and multiparatopic polypeptides of the invention may be as further described herein, and the various preferred aspects of the invention as described herein also apply to these biparatopic, triparatopic and multiparatopic polypeptides of the invention (for example, these biparatopic, triparatopic and multiparatopic polypeptides of the invention preferably comprise single variable domains and more preferably NANOBODIES® ($V_{HH}$ sequences)).

In a preferred, but non-limiting aspect, the amino acid sequences and (in particular) polypeptides of the invention are biparatopic (or multiparatopic) and are directed against the Synagis® binding site on the RSV F protein and/or capable of competing with Synagis® for binding to the RSV F protein, as well as against at least one other antigenic determinant, epitope, part or domain on the RSV F protein. The amino acid sequences and polypeptides of the invention may be directed against antigenic site II (also referred to as site A) of the RSV F protein as well as against at least one other antigenic determinant, epitope, part or domain on the RSV F protein. In a preferred aspect, the amino acid sequences and polypeptides of the invention are directed against region aa 250-275 of the RSV F protein as well as against at least one other antigenic determinant, epitope, part or domain on the RSV F protein.

Generally, such a biparatopic (or multiparatopic) polypeptide of the invention will contain at least one amino acid sequence of the invention that is capable of binding to the Synagis® binding site on the RSV F protein and/or capable of competing with Synagis® for binding to the RSV F protein (and in particular against antigenic site II (also referred to as site A) of the RSV F protein and more preferably against region aa 250-275 of the RSV F protein), as well as at least one further amino acid sequence of the invention that is capable of binding to at least one other antigenic determinant, epitope, part or domain on the RSV F protein. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the Synagis® binding site and the at least one other antigenic determinant, epitope, part or domain on the RSV F protein; and preferably comprise single variable domains and more preferably NANOBODIES® ($V_{HH}$ sequences)).

In another preferred, but non-limiting aspect, the amino acid sequences and (in particular) polypeptides of the invention are biparatopic (or multiparatopic) and are at least capable, upon binding to the RSV F protein, to neutralize a virus (as defined herein); to modulate, reduce and/or inhibit the infectivity of a virus (as defined herein); to modulate and in particular inhibit and/or prevent viral entry (as further defined herein) in a target host cell; and/or to modulate and in particular inhibit and/or prevent viral replication (as further defined herein) in a target host cell via the same mechanism of action as Synagis®.

In another preferred, but non-limiting aspect, the amino acid sequences and polypeptides of the invention are biparatopic (or multiparatopic) and are directed against the 101F binding site on the RSV F protein and/or capable of competing with 101F for binding to the RSV F protein, as well as against at least one other antigenic determinant on the RSV F protein. The amino acid sequences and polypeptides of the invention may be directed against antigenic site IV-VI of the RSV F protein as well as against at least one other antigenic determinant on the RSV F protein. In a preferred aspect, the amino acid sequences and polypeptides of the invention are directed against region aa 423-436 of the RSV F protein as well as against at least one other antigenic determinant on the RSV F protein.

Generally, such a biparatopic (or multiparatopic) polypeptide of the invention will contain at least one amino acid sequence of the invention that is capable of binding to the 101F binding site on the RSV F protein and/or capable of competing with 101F for binding to the RSV F protein (and in particular against antigenic site IV-VI of the RSV F protein and more preferably against region aa 423-436 of the RSV F protein), as well as at least one further amino acid sequence of the invention that is capable of binding to at least one other antigenic determinant, epitope, part or domain on the RSV F protein. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the 101F binding site and the at least one other antigenic determinant, epitope, part or domain on the RSV F protein; and preferably comprise single variable domains and more preferably NANOBODIES® ($V_{HH}$ sequences)).

In another preferred, but non-limiting aspect, the amino acid sequences and (in particular) polypeptides of the invention are biparatopic (or multiparatopic) and are at least capable, upon binding to the RSV F protein, to neutralize a virus (as defined herein); to modulate, reduce and/or inhibit the infectivity of a virus (as defined herein); to modulate and in particular inhibit and/or prevent viral entry (as further defined herein) in a target host cell; and/or to modulate and in particular inhibit and/or prevent viral replication (as further defined herein) in a target host cell via the same mechanism of action as 101F.

In another preferred, but non-limiting aspect, the amino acid sequences and (in particular) polypeptides of the invention are biparatopic and are at least directed against the Synagis® binding site on the RSV F protein as well as against the 101F binding site on the RSV F protein. The amino acid sequences and polypeptides of the invention may be directed against antigenic site II (also referred to as site A) of the RSV F protein. The amino acid sequences and polypeptides of the invention may be directed against antigenic site IV-VI of the RSV F protein. The amino acid sequences and polypeptides of the invention may be directed against antigenic site II (also referred to as site A) of the RSV F protein as well as against antigenic site IV-VI of the RSV F protein. In a preferred aspect, the amino acid sequences and polypeptides of the invention are directed against region aa 250-275 of the RSV F protein. In another preferred aspect, the amino acid sequences and polypeptides of the invention are directed against region aa 250-275 of the RSV F protein as well as against region aa 423-436 of the RSV F protein. In another preferred aspect, the amino acid sequences and polypeptides of the invention are directed against region aa 423-436 of the RSV F protein. In another preferred aspect, the amino acid sequences and polypeptides of the invention are directed against antigenic site II (also referred to as site A) of the RSV F protein as well as against the region aa 423-436 of the RSV F protein. In another preferred aspect, the amino acid sequences and polypeptides of the invention are directed against region aa 250-275 of the RSV F protein as well as against antigenic site IV-VI of the RSV F protein.

Generally, such a biparatopic (or multiparatopic) polypeptide of the invention will contain at least one amino acid sequence of the invention that is capable of binding to the Synagis® binding site on the RSV F protein and/or capable of competing with Synagis® for binding to the RSV F protein (and in particular against antigenic site II (also referred to as site A) of the RSV F protein and more preferably against region aa 250-275 of the RSV F protein), as well as at least one amino acid sequence of the invention that is capable of binding to the 101F binding site on the RSV F protein and/or capable of competing with 101F for binding to the RSV F protein (and in particular against antigenic site IV-VI of the RSV F protein and more preferably against region aa 423-436 of the RSV F protein). Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the Synagis® binding site and the 101F binding site on the RSV F protein; and preferably comprise single variable domains and more preferably NANOBODIES® ($V_{HH}$ sequences)).

In another preferred, but non-limiting aspect, the amino acid sequences and (in particular) polypeptides of the invention are biparatopic (or multiparatopic) and are at least capable, upon binding to the RSV F protein, to neutralize a virus (as defined herein); to modulate, reduce and/or inhibit the infectivity of a virus (as defined herein); to modulate and in particular inhibit and/or prevent viral entry (as further defined herein) in a target host cell; and/or to modulate and in particular inhibit and/or prevent viral replication (as further defined herein) in a target host cell via the same mechanism of action as Synagis® and 101F.

Again, the above biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the Synagis® binding site and the 101F binding site; and preferably comprise single variable domains and more preferably NANOBODIES® ($V_{HH}$ sequences)).

In another preferred, but non-limiting aspect, the amino acid sequences and (in particular) polypeptides of the invention are biparatopic with both paratopes directed against the Synagis® binding site on the RSV F protein. The amino acid sequences and polypeptides of the invention may be directed against antigenic site II (also referred to as site A) of the RSV F protein (one paratope or both paratopes). In a preferred aspect, the amino acid sequences and polypeptides of the invention are directed against region aa 250-275 of the RSV F protein (one paratope or both paratopes).

In another preferred, but non-limiting aspect, the amino acid sequences and (in particular) polypeptides of the invention are biparatopic with both paratopes directed against the 101F binding site on the RSV F protein. The amino acid sequences and polypeptides of the invention may be directed against antigenic site IV-VI of the RSV F protein (one paratope or both paratopes). In a preferred aspect, the amino acid sequences and polypeptides of the invention are directed against the region aa 423-436 of the RSV F protein (one paratope or both paratopes).

Again, the above biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind both binding sites; and preferably comprise single variable domains and more preferably NANOBODIES® ($V_{HH}$ sequences)).

In another preferred, but non-limiting aspect, the amino acid sequences and (in particular) polypeptides of the invention are biparatopic (or multiparatopic) and are directed against the sialic acid binding site on the hemagglutinin H5 envelope protein of influenza virus and/or capable of competing with sialic acid for binding to the hemagglutinin H5 envelope protein of influenza virus, as well as against at least one other antigenic determinant, epitope, part or domain on the hemagglutinin H5 envelope protein of influenza virus.

Generally, such a biparatopic (or multiparatopic) polypeptide of the invention will contain at least one amino acid sequence of the invention that is capable of binding to the sialic acid binding site on the hemagglutinin H5 envelope protein of influenza virus and/or capable of competing with sialic acid for binding to the hemagglutinin H5 envelope protein of influenza virus, as well as at least one further amino acid sequence of the invention that is capable of binding to at least one other antigenic determinant, epitope, part or domain on the hemagglutinin H5 envelope protein of influenza virus. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the sialic acid binding site and the at least one other antigenic determinant, epitope, part or domain on the hemagglutinin H5 envelope protein of influenza virus; and preferably comprise single variable domains and more preferably NANOBODIES® ($V_{HH}$ sequences)).

In another preferred, but non-limiting aspect, the amino acid sequences and (in particular) polypeptides of the invention are biparatopic (or multiparatopic) and are directed against the VN04-2 binding site on the hemagglutinin H5 envelope protein of influenza virus and/or capable of competing with VN04-2 for binding to the hemagglutinin H5 envelope protein of influenza virus, as well as against at least one other antigenic determinant, epitope, part or domain on the hemagglutinin H5 envelope protein of influenza virus.

Generally, such a biparatopic (or multiparatopic) polypeptide of the invention will contain at least one amino acid sequence of the invention that is capable of binding to the VN04-2 binding site on the hemagglutinin H5 envelope protein of influenza virus and/or capable of competing with VN04-2 for binding to the hemagglutinin H5 envelope protein of influenza virus, as well as at least one further amino acid sequence of the invention that is capable of binding to at least one other antigenic determinant, epitope, part or domain on the hemagglutinin H5 envelope protein of influenza virus. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the VN04-2 binding site and the at least one other antigenic determinant, epitope, part or domain on the hemagglutinin H5 envelope protein of influenza virus; and preferably comprise single variable domains and more preferably NANOBODIES® ($V_{HH}$ sequences)).

In another preferred, but non-limiting aspect, the amino acid sequences and (in particular) polypeptides of the invention are biparatopic (or multiparatopic) and are at least capable, upon binding to the hemagglutinin H5 envelope protein of influenza virus, to neutralize a virus (as defined herein); to modulate, reduce and/or inhibit the infectivity of a virus (as defined herein); to modulate and in particular inhibit and/or prevent viral entry (as further defined herein) in a target host cell; and/or to modulate and in particular inhibit and/or prevent viral replication (as further defined herein) in a target host cell via the same mechanism of action as VN04-2.

In another preferred, but non-limiting aspect, the amino acid sequences and (in particular) polypeptides of the invention are biparatopic (or multiparatopic) and are directed against the MAb C179 binding site on the hemagglutinin H5 envelope protein of influenza virus and/or capable of competing with MAb C179 for binding to the hemagglutinin H5 envelope protein of influenza virus, as well as against at least one other antigenic determinant, epitope, part or domain on the hemagglutinin H5 envelope protein of influenza virus.

Generally, such a biparatopic (or multiparatopic) polypeptide of the invention will contain at least one amino acid sequence of the invention that is capable of binding to the MAb C179 binding site on the hemagglutinin H5 envelope protein of influenza virus and/or capable of competing with MAb C179 for binding to the hemagglutinin H5 envelope protein of influenza virus, as well as at least one further amino acid sequence of the invention that is capable of binding to at least one other antigenic determinant, epitope, part or domain on the hemagglutinin H5 envelope protein of influenza virus. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the MAb C179 binding site and the at least one other antigenic determinant, epitope, part or domain on the hemagglutinin H5 envelope protein of influenza virus; and preferably comprise single variable domains and more preferably NANOBODIES® ($V_{HH}$ sequences)).

In another preferred, but non-limiting aspect, the amino acid sequences and (in particular) polypeptides of the invention are biparatopic (or multiparatopic) and are at least capable, upon binding to the hemagglutinin H5 envelope protein of influenza virus, to neutralize a virus (as defined herein); to modulate, reduce and/or inhibit the infectivity of a virus (as defined herein); to modulate and in particular inhibit and/or prevent viral entry (as further defined herein) in a target host cell; and/or to modulate and in particular inhibit and/or prevent viral replication (as further defined herein) in a target host cell via the same mechanism of action as MAb C179.

In another preferred, but non-limiting aspect, the amino acid sequences and (in particular) polypeptides of the invention are biparatopic (or multiparatopic) and are directed against the MAb 8-2 binding site on the G envelope protein of rabies and/or capable of competing with MAb 8-2 for binding to the G envelope protein, as well as against at least one other antigenic determinant, epitope, part or domain on the G envelope protein.

Generally, such a biparatopic (or multiparatopic) polypeptide of the invention will contain at least one amino acid sequence of the invention that is capable of binding to the MAb 8-2 binding site on the G envelope protein and/or capable of competing with MAb 8-2 for binding to the G envelope protein, as well as at least one further amino acid sequence of the invention that is capable of binding to at least one other antigenic determinant, epitope, part or domain on the G envelope protein. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the MAb 8-2 binding site and the at least one other antigenic determinant, epitope, part or domain on the G envelope protein; and preferably comprise single variable domains and more preferably NANOBODIES® ($V_{HH}$ sequences)).

In another preferred, but non-limiting aspect, the amino acid sequences and (in particular) polypeptides of the invention are biparatopic (or multiparatopic) and are at least capable, upon binding to the G envelope protein, to neutralize a virus (as defined herein); to modulate, reduce and/or inhibit the infectivity of a virus (as defined herein); to modulate and in particular inhibit and/or prevent viral entry (as further defined herein) in a target host cell; and/or to modulate and in particular inhibit and/or prevent viral replication (as further defined herein) in a target host cell via the same mechanism of action as MAb 8-2.

Also, the polypeptides of the present invention may also be directed against and/or can specifically bind to at least one particular envelope protein of a virus and at least one further epitope of another target, which is different from said at least one particular envelope protein. For example (but not limited to), the polypeptides of the present invention may be directed against and/or can specifically bind to at least one particular envelope protein of a virus and at least one further epitope of a virus, for instance at least one further epitope of a viral protein, such as at least one further epitope of another particular viral envelope protein. Thus, the polypeptides according to the invention may be directed against and/or may specifically bind to at least two (or even more) epitopes of at least two different envelope proteins. Also, said at least one further epitope of a virus may or may not be involved in one or more of the viral-mediated biological pathways, in which an envelope protein of a virus and/or its viral receptor is involved; more specifically said at least one further epitope of a virus may or may not be involved in viral entry in a target host cell, such as virion attachment to a target host cell and/or viral fusion with a target host cell or said at least one further epitope of a virus may or may not be involved in viral replication in a target host cell, such as viral transcription and/or viral translation and/or viral packaging and/or the formation of functional virions and/or budding of nascent virions from the target host cell membrane.

Generally, bi-, and multivalent (as defined herein), bi-, and multispecific (as defined herein) and bi-, and multiparatopic (as defined herein) polypeptides according to the invention may be useful for the prevention and/or treatment of viral diseases by specifically binding to at least one epitope of an envelope protein of a virus and at least one further epitope (which may or may not be different from said at least one epitope) of a target, wherein said target may or may not be different from said envelope protein.

Preferably, bi-, and multiparatopic polypeptides (as defined herein) according to the invention may be useful for the prevention and/or treatment of viral diseases by specifically binding to at least two (or even more) epitopes (which may be the same or different) on the same envelope protein of a virus.

Alternatively, the polypeptides of the present invention may be directed against and/or can specifically bind to at least one epitope of an envelope protein of a virus and at least one further epitope of another target, which is different from said particular envelope protein and which is for instance a further epitope of a virus, such as a further epitope of a viral protein or a further epitope of another particular viral envelope protein.

In another preferred aspect, the amino acid sequences and (in particular) polypeptides of the invention are capable of binding to three (different) antigenic determinants, epitopes, parts, domains of an envelope protein of a virus. In this context, the amino acid sequences and polypeptides of the invention are also referred to as "trivalent" (such as e.g. "trivalent triparatopic" or "trivalent biparatopic", "trivalent monoparatopic", etc.) amino acid sequences and polypeptides. The trivalent amino acid sequences and polypeptides of the invention can be directed against any antigenic determinants, epitopes, parts, and/or domains of the envelope protein of the virus.

For example, and generally, a trivalent polypeptide of the invention may comprise three amino acid sequences of the invention directed against the same antigenic determinant, epitope, part or domain of the viral envelope protein (in which said amino acid sequences may be suitably linked, for example via a suitable linker as further described herein). A trivalent polypeptide of the invention may comprise two amino acid sequences of the invention directed against a first antigenic determinant, epitope, part or domain of the viral envelope protein, and at least one amino acid sequence of the invention directed against a second antigenic determinant, epitope, part or domain of the viral envelope protein different from the first antigenic determinant, epitope, part or domain (in which said amino acid sequences may be suitably linked, for example via a suitable linker as further described herein). Such a trivalent polypeptide of the invention may also be referred to as "trivalent biparatopic". A trivalent polypeptide of the invention may comprise one amino acid sequence of the invention directed against a first antigenic determinant, epitope, part or domain of the viral envelope protein, at least one amino acid sequence of the invention directed against a second antigenic determinant, epitope, part or domain of the viral envelope protein different from the first antigenic determinant, epitope, part or domain and at least one amino acid sequence of the invention directed against a third antigenic determinant, epitope, part or domain of the viral envelope protein different from the first and the second antigenic determinant, epitope, part or domain (in which said amino acid sequences may be suitably linked, for example via a suitable linker as further described herein). Such a trivalent polypeptide of the invention may also be referred to as "trivalent triparatopic". A trivalent polypeptide of the invention may comprise two amino acid sequences of the invention directed against a first antigenic determinant, epitope, part or domain of the viral envelope protein, and at least one amino acid sequence of the invention directed against a second antigenic determinant, epitope, part or domain of a viral envelope protein different from the first viral envelope protein. Such a trivalent polypeptide of the invention may also be referred to as "trivalent bispecific". A trivalent polypeptide of the invention may also comprise one amino acid sequence of the invention directed against a first antigenic determinant, epitope, part or domain of the viral envelope protein, at least one amino acid sequence of the invention directed against a second antigenic determinant, epitope, part or domain of the same viral envelope protein different from the first antigenic determinant, epitope, part or domain and at least one amino acid sequence of the invention directed against a third antigenic determinant, epitope, part or domain of a viral envelope protein different from the first viral envelope protein (in which said amino acid sequences may be suitably linked, for example via a suitable linker as further described herein). Such a trivalent polypeptide of the invention may also be referred to as "trivalent trispecific". A trivalent polypeptide of the invention may also comprise one amino acid sequence of the invention directed against a first antigenic determinant, epitope, part or domain of the viral envelope protein, at least one amino acid sequence of the invention directed against a second antigenic determinant, epitope, part or domain of a viral envelope protein different from the first viral envelope protein and at least one amino acid sequence of the invention directed against a third antigenic determinant, epitope, part or domain of a viral envelope protein different from the first and the second viral envelope protein (in which said amino acid sequences may be suitably linked, for example via a suitable linker as further described herein). Such a trivalent polypeptide of the invention may also be referred to as "trivalent trispecific".

Preferably, such a trivalent polypeptide of the invention is further such that, when it binds to the viral envelope protein, it is capable of simultaneously binding to the first antigenic determinant, epitope, part or domain (i.e. via the at least one amino acid sequence of the invention capable of binding to said first antigenic determinant, epitope, part or domain), binding to said second antigenic determinant, epitope, part or domain (i.e. via the at least one amino acid sequence of the invention capable of binding to said second antigenic determinant, epitope, part or domain) and binding to said third antigenic determinant, epitope, part or domain (i.e. via the at least one amino acid sequence of the invention capable of binding to said third antigenic determinant, epitope, part or domain). Examples of such trivalent polypeptides of the invention will become clear from the further description herein. Generally, such trivalent polypeptides of the invention may be as further described herein, and the various preferred aspects of the invention as described herein also apply to these trivalent polypeptides of the invention (for example, these trivalent polypeptides of the invention preferably comprise single variable domains and more preferably NANOBODIES® ($V_{HH}$ sequences)).

In a preferred, but non-limiting aspect, the amino acid sequences and (in particular) polypeptides of the invention are trivalent and comprise one amino acid sequence of the invention directed against the Synagis® binding site on the RSV F protein and/or capable of competing with Synagis for binding to the RSV F protein, as well as two amino acid sequences of the invention directed against another antigenic determinant, epitope, part or domain on the RSV F protein. The amino acid sequences and polypeptides of the invention that are directed against the Synagis® binding site on the RSV F protein may be directed against antigenic site II (also referred to as site A) of the RSV F protein. In a preferred aspect, the amino acid sequences and polypeptides of the invention that are directed against the Synagis® binding site on the RSV F protein are directed against region aa 250-275 of the RSV F protein. Generally, such a trivalent polypeptide of the invention will contain at least one amino acid sequence of the invention that is capable of binding to the Synagis® binding site on the RSV F protein and/or capable of competing with Synagis® for binding to the RSV F protein (and in particular against antigenic site II (also referred to as site A) of the RSV F protein and more preferably against region aa 250-275 of the RSV F protein), as well as two further amino acid sequences of the invention that are capable of binding to two other antigenic determinants, epitopes, parts or domains on the RSV F protein. Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; are preferably such that they can simultaneously bind the Synagis® binding site and the two other antigenic determinants, epitopes, parts or domains on the RSV F protein; and preferably comprise single variable domains and more preferably NANOBODIES® ($V_{HH}$ sequences)).

In another preferred, but non-limiting aspect, the amino acid sequences and (in particular) polypeptides of the invention are trivalent and comprise two amino acid sequences of the invention directed against the Synagis® binding site on the RSV F protein and/or capable of competing with Synagis for binding to the RSV F protein, as well as one amino acid sequence of the invention directed against another antigenic determinant, epitope, part or domain on the RSV F protein. The amino acid sequences and polypeptides of the invention that are directed against the Synagis® binding site on the RSV F protein may be directed against antigenic site II (also referred to as site A) of the RSV F protein. In a preferred aspect, the amino acid sequences and polypeptides of the invention that are directed against the Synagis® binding site on the RSV F protein are directed against region aa 250-275 of the RSV F protein. Generally, such a trivalent polypeptide of the invention will contain two amino acid sequences of the invention that are capable of binding to the Synagis® binding site on the RSV F protein and/or capable of competing with Synagis® for binding to the RSV F protein (and in particular against antigenic site II (also referred to as site A) of the RSV F protein and more preferably against region aa 250-275 of the RSV F protein), as well as one further amino acid sequence of the invention that is capable of binding to another antigenic determinant, epitope, part or domain on the RSV F protein. Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; are preferably such that they can simultaneously bind the Synagis® binding site and the other antigenic determinant, epitope, part or domain on the RSV F protein; and preferably comprise single variable domains and more preferably NANOBODIES® ($V_{HH}$ sequences)).

In another preferred, but non-limiting aspect, the amino acid sequences and (in particular) polypeptides of the invention are trivalent and comprise three amino acid sequences of the invention directed against the Synagis® binding site on the RSV F protein and/or capable of competing with Synagis for binding to the RSV F protein. The amino acid sequences and polypeptides of the invention that are directed against the Synagis® binding site on the RSV F protein may be directed against antigenic site II (also referred to as site A) of the RSV F protein. In a preferred aspect, the amino acid sequences and polypeptides of the invention that are directed against the Synagis® binding site on the RSV F protein are directed against region aa 250-275 of the RSV F protein. Generally, such a trivalent polypeptide of the invention will contain three amino acid sequences of the invention that are capable of binding to the Synagis® binding site on the RSV F protein and/or capable of competing with Synagis® for binding to the RSV F protein (and in particular against antigenic site II (also referred to as site A) of the RSV F protein and more preferably against region aa 250-275 of the RSV F protein). Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; are preferably such that they can simultaneously bind the Synagis® binding site; and preferably comprise single variable domains and more preferably NANOBODIES® ($V_{HH}$ sequences)).

In another preferred, but non-limiting aspect, the amino acid sequences and (in particular) polypeptides of the invention are trivalent and are at least capable, upon binding to the RSV F protein, to neutralize a virus (as defined herein); to modulate, reduce and/or inhibit the infectivity of a virus (as defined herein); to modulate and in particular inhibit and/or prevent viral entry (as further defined herein) in a target host cell; and/or to modulate and in particular inhibit and/or prevent viral replication (as further defined herein) in a target host cell via the same mechanism of action as Synagis®.

In a preferred, but non-limiting aspect, the amino acid sequences and (in particular) polypeptides of the invention are trivalent and comprise one amino acid sequence of the invention directed against the 101F binding site on the RSV F protein and/or capable of competing with 101F for binding to the RSV F protein, as well as two amino acid sequences of the invention directed against another antigenic determinant, epitope, part or domain on the RSV F protein. The amino acid sequences and polypeptides of the invention that are directed against the 101F binding site on the RSV F protein may be directed against antigenic site IV-VI of the RSV F protein. In a preferred aspect, the amino acid sequences and polypeptides of the invention that are directed against the 101F binding site on the RSV F protein are directed against region aa 423-436 of the RSV F protein. Generally, such a trivalent polypeptide of the invention will contain at least one amino acid sequence of the invention that is capable of binding to the 101F binding site on the RSV F protein and/or capable of competing with 101F for binding to the RSV F protein (and in particular against antigenic site IV-VI of the RSV F protein and more preferably against region aa 423-436 of the RSV F protein), as well as two further amino acid sequences of the invention that are capable of binding to two other antigenic determinants, epitopes, parts or domains on the RSV F protein. Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; are preferably such that they can simultaneously bind the 101F binding site and the two other antigenic determinants, epitopes, parts or domains on the RSV F protein; and preferably comprise single variable domains and more preferably NANOBODIES® ($V_{HH}$ sequences)).

In another preferred, but non-limiting aspect, the amino acid sequences and (in particular) polypeptides of the invention are trivalent and comprise two amino acid sequences of the invention directed against the 101F binding site on the RSV F protein and/or capable of competing with 101F for binding to the RSV F protein, as well as one amino acid sequence of the invention directed against another antigenic determinant, epitope, part or domain on the RSV F protein. The amino acid sequences and polypeptides of the invention that are directed against the 101F binding site on the RSV F protein may be directed against antigenic site IV-VI of the RSV F protein. In a preferred aspect, the amino acid sequences and polypeptides of the invention that are directed against the 101F binding site on the RSV F protein are directed against region aa 423-436 of the RSV F protein. Generally, such a trivalent polypeptide of the invention will contain two amino acid sequences of the invention that are capable of binding to the 101F binding site on the RSV F protein and/or capable of competing with 101F for binding to the RSV F protein (and in particular against antigenic site IV-VI of the RSV F protein and more preferably against region aa 423-436 of the RSV F protein), as well as one further amino acid sequence of the invention that is capable of binding to another antigenic determinant, epitope, part or domain on the RSV F protein. Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; are preferably such that they can simultaneously bind the 101F binding site and the other antigenic determinant, epitope, part or domain on the RSV F protein; and preferably comprise single variable domains and more preferably NANOBODIES® ($V_{HH}$ sequences)).

In another preferred, but non-limiting aspect, the amino acid sequences and (in particular) polypeptides of the invention are trivalent and comprise three amino acid sequences of the invention directed against the 101F binding site on the RSV F protein and/or capable of competing with 101F for binding to the RSV F protein. The amino acid sequences and polypeptides of the invention that are directed against the 101F binding site on the RSV F protein may be directed against antigenic site IV-VI of the RSV F protein. In a preferred aspect, the amino acid sequences and polypeptides of the invention that are directed against the 101F binding site on the RSV F protein are directed against region aa 423-436 of the RSV F protein. Generally, such a trivalent polypeptide of the invention will contain three amino acid sequences of the invention that are capable of binding to the 101F binding site on the RSV F protein and/or capable of competing with 101F for binding to the RSV F protein (and in particular against antigenic site IV-VI of the RSV F protein and more preferably against region aa 423-436 of the RSV F protein). Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; are preferably such that they can simultaneously bind the 101F binding site; and preferably comprise single variable domains and more preferably NANOBODIES® ($V_{HH}$ sequences)).

In another preferred, but non-limiting aspect, the amino acid sequences and (in particular) polypeptides of the invention are trivalent and are at least capable, upon binding to the RSV F protein, to neutralize a virus (as defined herein); to modulate, reduce and/or inhibit the infectivity of a virus (as defined herein); to modulate and in particular inhibit and/or prevent viral entry (as further defined herein) in a target host cell; and/or to modulate and in particular inhibit and/or prevent viral replication (as further defined herein) in a target host cell via the same mechanism of action as 101F.

In another preferred, but non-limiting aspect, the amino acid sequences and (in particular) polypeptides of the invention are trivalent and comprise two amino acid sequences of the invention directed against the Synagis® binding site on the RSV F protein and/or capable of competing with Synagis for binding to the RSV F protein, as well as one amino acid sequence of the invention directed against the 101F binding site on the RSV F protein and/or capable of competing with 101F for binding to the RSV F protein. The amino acid sequences and polypeptides of the invention that are directed against the Synagis® binding site on the RSV F protein may be directed against antigenic site II (also referred to as site A) of the RSV F protein. In a preferred aspect, the amino acid sequences and polypeptides of the invention that are directed against the Synagis® binding site on the RSV F protein are directed against region aa 250-275 of the RSV F protein. The amino acid sequences and polypeptides of the invention that are directed against the 101F binding site on the RSV F protein may be directed against antigenic site IV-VI of the RSV F protein. In a preferred aspect, the amino acid sequences and polypeptides of the invention that are directed against the 101F binding site on the RSV F protein are directed against region aa 423-436 of the RSV F protein. Generally, such a trivalent polypeptide of the invention will contain two amino acid sequences of the invention that are capable of binding to the Synagis® binding site on the RSV F protein and/or capable of competing with Synagis® for binding to the RSV F protein (and in particular against antigenic site II (also referred to as site A) of the RSV F protein and more preferably against region aa 250-275 of the RSV F protein), as well as one further amino acid sequence of the invention that is capable of binding to the 101F binding site on the RSV F protein and/or capable of competing with 101F for binding to the RSV F protein (and in particular against antigenic site IV-VI of the RSV F protein and more preferably against region aa 423-436 of the RSV F protein). Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; are preferably such that they can simultaneously bind the Synagis® binding site and the 101F binding site on the RSV F protein; and preferably comprise single variable domains and more preferably NANOBODIES® ($V_{HH}$ sequences)).

In another preferred, but non-limiting aspect, the amino acid sequences and (in particular) polypeptides of the invention are trivalent and comprise one amino acid sequence of the invention directed against the Synagis® binding site on the RSV F protein and/or capable of competing with Synagis for binding to the RSV F protein, as well as two amino acid sequences of the invention directed against the 101F binding site on the RSV F protein and/or capable of competing with 101F for binding to the RSV F protein. The amino acid sequences and polypeptides of the invention that are directed against the Synagis® binding site on the RSV F protein may be directed against antigenic site II (also referred to as site A)

of the RSV F protein. In a preferred aspect, the amino acid sequences and polypeptides of the invention that are directed against the Synagis® binding site on the RSV F protein are directed against region aa 250-275 of the RSV F protein. The amino acid sequences and polypeptides of the invention that are directed against the 101F binding site on the RSV F protein may be directed against antigenic site IV-VI of the RSV F protein. In a preferred aspect, the amino acid sequences and polypeptides of the invention that are directed against the 101F binding site on the RSV F protein are directed against region aa 423-436 of the RSV F protein. Generally, such a trivalent polypeptide of the invention will contain one amino acid sequence of the invention that is capable of binding to the Synagis® binding site on the RSV F protein and/or capable of competing with Synagis® for binding to the RSV F protein (and in particular against antigenic site II (also referred to as site A) of the RSV F protein and more preferably against region aa 250-275 of the RSV F protein), as well as two further amino acid sequences of the invention that are capable of binding to the 101F binding site on the RSV F protein and/or capable of competing with 101F for binding to the RSV F protein (and in particular against antigenic site IV-VI of the RSV F protein and more preferably against region aa 423-436 of the RSV F protein). Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; are preferably such that they can simultaneously bind the Synagis® binding site and the 101F binding site on the RSV F protein; and preferably comprise single variable domains and more preferably NANOBODIES® ($V_{HH}$ sequences)).

In another preferred, but non-limiting aspect, the amino acid sequences and (in particular) polypeptides of the invention are trivalent and comprise one amino acid sequence of the invention directed against the Synagis® binding site on the RSV F protein and/or capable of competing with Synagis for binding to the RSV F protein, one amino acid sequence of the invention directed against the 101F binding site on the RSV F protein and/or capable of competing with 101F for binding to the RSV F protein, as well as one amino acid sequence of the invention directed against another antigenic determinant, epitope, part or domain on the RSV F protein. The amino acid sequences and polypeptides of the invention that are directed against the Synagis® binding site on the RSV F protein may be directed against antigenic site II (also referred to as site A) of the RSV F protein. In a preferred aspect, the amino acid sequences and polypeptides of the invention that are directed against the Synagis® binding site on the RSV F protein are directed against region aa 250-275 of the RSV F protein. The amino acid sequences and polypeptides of the invention that are directed against the 101F binding site on the RSV F protein may be directed against antigenic site IV-VI of the RSV F protein. In a preferred aspect, the amino acid sequences and polypeptides of the invention that are directed against the 101F binding site on the RSV F protein are directed against region aa 423-436 of the RSV F protein. Generally, such a trivalent polypeptide of the invention will contain one amino acid sequence of the invention that is capable of binding to the Synagis® binding site on the RSV F protein and/or capable of competing with Synagis® for binding to the RSV F protein (and in particular against antigenic site II (also referred to as site A) of the RSV F protein and more preferably against region aa 250-275 of the RSV F protein), one further amino acid sequence of the invention that is capable of binding to the 101F binding site on the RSV F protein and/or capable of competing with 101F for binding to the RSV F protein (and in particular against antigenic site IV-VI of the RSV F protein and more preferably against region aa 423-436 of the RSV F protein), as well as one further amino acid sequence of the invention directed against another antigenic determinant, epitope, part or domain on the RSV F protein. Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; are preferably such that they can simultaneously bind the Synagis® binding site, the 101F binding site and the other antigenic determinant, epitope, part or domain on the RSV F protein; and preferably comprise single variable domains and more preferably NANOBODIES® ($V_{HH}$ sequences)).

In another preferred, but non-limiting aspect, the amino acid sequences and (in particular) polypeptides of the invention are trivalent and are at least capable, upon binding to the RSV F protein, to neutralize a virus (as defined herein); to modulate, reduce and/or inhibit the infectivity of a virus (as defined herein); to modulate and in particular inhibit and/or prevent viral entry (as further defined herein) in a target host cell; and/or to modulate and in particular inhibit and/or prevent viral replication (as further defined herein) in a target host cell via the same mechanism of action as Synagis® and/or 101F.

In a preferred, but non-limiting aspect, the amino acid sequences and (in particular) polypeptides of the invention are trivalent and comprise one amino acid sequence of the invention directed against the sialic acid binding site on the hemagglutinin H5 envelope protein of influenza virus and/or capable of competing with sialic acid for binding to the hemagglutinin H5 envelope protein of influenza virus, as well as two amino acid sequences of the invention directed against another antigenic determinant, epitope, part or domain on the hemagglutinin H5 envelope protein of influenza virus. Generally, such a trivalent polypeptide of the invention will contain at least one amino acid sequence of the invention that is capable of binding to the sialic acid binding site on the hemagglutinin H5 envelope protein of influenza virus and/or capable of competing with sialic acid for binding to the hemagglutinin H5 envelope protein of influenza virus, as well as two further amino acid sequences of the invention that are capable of binding to two other antigenic determinants, epitopes, parts or domains on the hemagglutinin H5 envelope protein of influenza virus. Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; are preferably such that they can simultaneously bind the sialic acid binding site and the two other antigenic determinants, epitopes, parts or domains on the hemagglutinin H5 envelope protein of influenza virus; and preferably comprise single variable domains and more preferably NANOBODIES® ($V_{HH}$ sequences)).

In another preferred, but non-limiting aspect, the amino acid sequences and (in particular) polypeptides of the invention are trivalent and comprise two amino acid sequences of the invention directed against the sialic acid binding site on the hemagglutinin H5 envelope protein of influenza virus and/or capable of competing with sialic acid for binding to the hemagglutinin H5 envelope protein of influenza virus, as well as one amino acid sequence of the invention directed against another antigenic determinant, epitope, part or domain on the hemagglutinin H5 envelope protein of influenza virus. Generally, such a trivalent polypeptide of the invention will contain two amino acid sequences of the invention that are capable of binding to the sialic acid binding site on the hemagglutinin H5 envelope protein of influenza virus and/or capable of competing with sialic acid for binding to the hemagglutinin H5 envelope protein of influenza virus, as well as one further amino acid sequence of the invention that is capable of binding to another antigenic determinant, epitope, part or domain on the hemagglutinin H5 envelope protein of influenza virus. Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; are preferably such that they can simultaneously bind the sialic acid binding site and the other antigenic determinant, epitope, part or domain on the hemagglutinin H5 envelope protein of influenza virus; and preferably comprise single variable domains and more preferably NANOBODIES® ($V_{HH}$ sequences)).

In another preferred, but non-limiting aspect, the amino acid sequences and (in particular) polypeptides of the invention are trivalent and comprise three amino acid sequences of the invention directed against the sialic acid binding site on the hemagglutinin H5 envelope protein of influenza virus and/or capable of competing with sialic acid for binding to the hemagglutinin H5 envelope protein of influenza virus. Generally, such a trivalent polypeptide of the invention will contain three amino acid sequences of the invention that are capable of binding to the sialic acid binding site on the hemagglutinin H5 envelope protein of influenza virus and/or capable of competing with sialic acid for binding to the hemagglutinin H5 envelope protein of influenza virus. Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; are preferably such that they can simultaneously bind the sialic acid binding site; and preferably comprise single variable domains and more preferably NANOBODIES® ($V_{HH}$ sequences)).

In a preferred, but non-limiting aspect, the amino acid sequences and (in particular) polypeptides of the invention are trivalent and comprise one amino acid sequence of the invention directed against the VN04-2 binding site on the hemagglutinin H5 envelope protein of influenza virus and/or capable of competing with VN04-2 for binding to the hemagglutinin H5 envelope protein of influenza virus, as well as two amino acid sequences of the invention directed against another antigenic determinant, epitope, part or domain on the hemagglutinin H5 envelope protein of influenza virus. Generally, such a trivalent polypeptide of the invention will contain at least one amino acid sequence of the invention that is capable of binding to the VN04-2 binding site on the hemagglutinin H5 envelope protein of influenza virus and/or capable of competing with VN04-2 for binding to the hemagglutinin H5 envelope protein of influenza virus, as well as two further amino acid sequences of the invention that are capable of binding to two other antigenic determinants, epitopes, parts or domains on the hemagglutinin H5 envelope protein of influenza virus. Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; are preferably such that they can simultaneously bind the VN04-2 binding site and the two other antigenic determinants, epitopes, parts or domains on the hemagglutinin H5 envelope protein of influenza virus; and preferably comprise single variable domains and more preferably NANOBODIES® ($V_{HH}$ sequences)).

In another preferred, but non-limiting aspect, the amino acid sequences and (in particular) polypeptides of the invention are trivalent and comprise two amino acid sequences of the invention directed against the VN04-2 binding site on the hemagglutinin H5 envelope protein of influenza virus and/or capable of competing with VN04-2 for binding to the hemagglutinin H5 envelope protein of influenza virus, as well as one amino acid sequence of the invention directed against another antigenic determinant, epitope, part or domain on the hemagglutinin H5 envelope protein of influenza virus. Generally, such a trivalent polypeptide of the invention will contain two amino acid sequences of the invention that are capable of binding to the VN04-2 binding site on the hemagglutinin H5 envelope protein of influenza virus and/or capable of competing with VN04-2 for binding to the hemagglutinin H5 envelope protein of influenza virus, as well as one further amino acid sequence of the invention that is capable of binding to another antigenic determinant, epitope, part or domain on the hemagglutinin H5 envelope protein of influenza virus. Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; are preferably such that they can simultaneously bind the VN04-2 binding site and the other antigenic determinant, epitope, part or domain on the hemagglutinin H5 envelope protein of influenza virus; and preferably comprise single variable domains and more preferably NANOBODIES® ($V_{HH}$ sequences)).

In another preferred, but non-limiting aspect, the amino acid sequences and (in particular) polypeptides of the invention are trivalent and comprise three amino acid sequences of the invention directed against the VN04-2 binding site on the hemagglutinin H5 envelope protein of influenza virus and/or capable of competing with VN04-2 for binding to the hemagglutinin H5 envelope protein of influenza virus. Generally, such a trivalent polypeptide of the invention will contain three amino acid sequences of the invention that are capable of binding to the VN04-2 binding site on the hemagglutinin H5 envelope protein of influenza virus and/or capable of competing with VN04-2 for binding to the hemagglutinin H5 envelope protein of influenza virus. Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; are preferably such that they can simultaneously bind the VN04-2 binding site; and preferably comprise single variable domains and more preferably NANOBODIES® ($V_{HH}$ sequences)).

In another preferred, but non-limiting aspect, the amino acid sequences and (in particular) polypeptides of the invention are trivalent and are at least capable, upon binding to the hemagglutinin H5 envelope protein of influenza virus, to neutralize a virus (as defined herein); to modulate, reduce and/or inhibit the infectivity of a virus (as defined herein); to modulate and in particular inhibit and/or prevent viral entry (as further defined herein) in a target host cell; and/or to modulate and in particular inhibit and/or prevent viral replication (as further defined herein) in a target host cell via the same mechanism of action as VN04-2.

In a preferred, but non-limiting aspect, the amino acid sequences and (in particular) polypeptides of the invention are trivalent and comprise one amino acid sequence of the invention directed against the MAb C179 binding site on the hemagglutinin H5 envelope protein of influenza virus and/or capable of competing with MAb C179 for binding to the hemagglutinin H5 envelope protein of influenza virus, as well as two amino acid sequences of the invention directed against another antigenic determinant, epitope, part or domain on the hemagglutinin H5 envelope protein of influenza virus. Generally, such a trivalent polypeptide of the invention will contain at least one amino acid sequence of the invention that is capable of binding to the MAb C179 binding site on the hemagglutinin H5 envelope protein of influenza virus and/or capable of competing with MAb C179 for binding to the hemagglutinin H5 envelope protein of influenza virus, as well as two further amino acid sequences of the invention that are capable of binding to two other antigenic determinants, epitopes, parts or domains on the hemagglutinin H5 envelope protein of influenza virus. Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; are preferably such that they can simultaneously bind the MAb C179 binding site and the two other antigenic determinants, epitopes, parts or domains on the hemagglutinin H5 envelope protein of influenza virus; and preferably comprise single variable domains and more preferably NANOBODIES® ($V_{HH}$ sequences)).

In another preferred, but non-limiting aspect, the amino acid sequences and (in particular) polypeptides of the invention are trivalent and comprise two amino acid sequences of the invention directed against the MAb C179 binding site on the hemagglutinin H5 envelope protein of influenza virus and/or capable of competing with MAb C179 for binding to the hemagglutinin H5 envelope protein of influenza virus, as well as one amino acid sequence of the invention directed against another antigenic determinant, epitope, part or domain on the hemagglutinin H5 envelope protein of influenza virus. Generally, such a trivalent polypeptide of the invention will contain two amino acid sequences of the invention that are capable of binding to the MAb C179 binding site on the hemagglutinin H5 envelope protein of influenza virus and/or capable of competing with MAb C179 for binding to the hemagglutinin H5 envelope protein of influenza virus, as well as one further amino acid sequence of the invention that is capable of binding to another antigenic determinant, epitope, part or domain on the hemagglutinin H5 envelope protein of influenza virus. Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; are preferably such that they can simultaneously bind the MAb C179 binding site and the other antigenic determinant, epitope, part or domain on the hemagglutinin H5 envelope protein of influenza virus; and preferably comprise single variable domains and more preferably NANOBODIES® ($V_{HH}$ sequences)).

In another preferred, but non-limiting aspect, the amino acid sequences and (in particular) polypeptides of the invention are trivalent and comprise three amino acid sequences of the invention directed against the MAb C179 binding site on the hemagglutinin H5 envelope protein of influenza virus and/or capable of competing with MAb C179 for binding to the hemagglutinin H5 envelope protein of influenza virus. Generally, such a trivalent polypeptide of the invention will contain three amino acid sequences of the invention that are capable of binding to the MAb C179 binding site on the hemagglutinin H5 envelope protein of influenza virus and/or capable of competing with MAb C179 for binding to the hemagglutinin H5 envelope protein of influenza virus. Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; are preferably such that they can simultaneously bind the MAb C179 binding site; and preferably comprise single variable domains and more preferably NANOBODIES® ($V_{HH}$ sequences)).

In another preferred, but non-limiting aspect, the amino acid sequences and (in particular) polypeptides of the invention are trivalent and are at least capable, upon binding to the hemagglutinin H5 envelope protein of influenza virus, to neutralize a virus (as defined herein); to modulate, reduce and/or inhibit the infectivity of a virus (as defined herein); to modulate and in particular inhibit and/or prevent viral entry (as further defined herein) in a target host cell; and/or to modulate and in particular inhibit and/or prevent viral replication (as further defined herein) in a target host cell via the same mechanism of action as MAb C179.

In a preferred, but non-limiting aspect, the amino acid sequences and (in particular) polypeptides of the invention are trivalent and comprise one amino acid sequence of the invention directed against the MAb 8-2 binding site on the G envelope protein of rabies and/or capable of competing with MAb 8-2 for binding to the G envelope protein, as well as two amino acid sequences of the invention directed against another antigenic determinant, epitope, part or domain on the G envelope protein. Generally, such a trivalent polypeptide of the invention will contain at least one amino acid sequence of the invention that is capable of binding to the MAb 8-2 binding site on the G envelope protein and/or capable of competing with MAb 8-2 for binding to the G envelope protein, as well as two further amino acid sequences of the invention that are capable of binding to two other antigenic determinants, epitopes, parts or domains on the G envelope protein. Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; are preferably such that they can simultaneously bind the MAb 8-2 binding site and the two other antigenic determinants, epitopes, parts or domains on the G envelope protein; and preferably comprise single variable domains and more preferably NANOBODIES® ($V_{HH}$ sequences)).

In another preferred, but non-limiting aspect, the amino acid sequences and (in particular) polypeptides of the invention are trivalent and comprise two amino acid sequences of the invention directed against the MAb 8-2 binding site on the G envelope protein and/or capable of competing with MAb 8-2 for binding to the G envelope protein, as well as one amino acid sequence of the invention directed against another antigenic determinant, epitope, part or domain on the G envelope protein. Generally, such a trivalent polypeptide of the invention will contain two amino acid sequences of the invention that are capable of binding to the MAb 8-2 binding site on the G envelope protein and/or capable of competing with MAb 8-2 for binding to the G envelope protein, as well as one further amino acid sequence of the invention that is capable of binding to another antigenic determinant, epitope, part or domain on the G envelope protein. Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; are preferably such that they can simultaneously bind the MAb 8-2 binding site and the other antigenic determinant, epitope, part or domain on the G envelope protein; and preferably comprise single variable domains and more preferably NANOBODIES® ($V_{HH}$ sequences)).

In another preferred, but non-limiting aspect, the amino acid sequences and (in particular) polypeptides of the invention are trivalent and comprise three amino acid sequences of the invention directed against the MAb 8-2 binding site on the G envelope protein and/or capable of competing with MAb 8-2 for binding to the G envelope protein. Generally, such a trivalent polypeptide of the invention will contain three amino acid sequences of the invention that are capable of binding to the MAb 8-2 binding site on the G envelope protein and/or capable of competing with MAb 8-2 for binding to the G envelope protein. Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; are preferably such that they can simultaneously bind the MAb 8-2 binding site; and preferably comprise single variable domains and more preferably NANOBODIES® ($V_{HH}$ sequences)).

In another preferred, but non-limiting aspect, the amino acid sequences and (in particular) polypeptides of the invention are trivalent and are at least capable, upon binding to the G envelope protein of rabies, to neutralize a virus (as defined herein); to modulate, reduce and/or inhibit the infectivity of a virus (as defined herein); to modulate and in particular inhibit and/or prevent viral entry (as further defined herein) in a target host cell; and/or to modulate and in particular inhibit and/or prevent viral replication (as further defined herein) in a target host cell via the same mechanism of action as MAb 8-2.

Preferred bivalent and trivalent constructs of the invention are given in Tables C-6, Table A-2, Table A-4, Table A-5 and Table A-6.

Preferably, such bi-, tri-, and multivalent, bi-, tri-, and multispecific, and/or bi-, tri-, and multiparatopic polypeptides, as discussed hereabove, will bind to an envelope protein of a virus with increased avidity compared to a single amino acid sequence of the invention.

More specifically, bi-, tri-, and multiparatopic polypeptides and/or bi-, tri-, and multispecific polypeptides according to the invention may be useful in targeting multiple viral receptor binding sites on the same and on different envelope proteins, respectively, which can result in an increased potency of viral neutralization (as defined herein) compared to a single amino acid sequence of the invention. Also, bi-, tri-, and multivalent, bi-, tri-, and multispecific and/or bi-, tri-, and multiparatopic polypeptides according to the invention may be useful in binding different genotypes, different subtypes and/or different strains of a certain virus. Also, bi-, tri-, and multivalent, bi-, tri-, and multispecific and/or bi-, tri-, and multiparatopic polypeptides according to the invention may be useful in preventing viral escape and/or viral evasion.

In a specific aspect of the invention, the bi-, tri-, and multivalent, bi-, tri-, and multispecific and/or bi-, tri-, and multiparatopic polypeptides according to the invention may be directed against influenza virus and may bind influenza subtype H5N1 as well as influenza subtype H1N1. In another aspect, the bi-, tri-, and multivalent, bi-, tri-, and multispecific and/or bi-, tri-, and multiparatopic polypeptides according to the invention may bind influenza subtype H5N1 as well as influenza subtype H3N2. In another aspect, the bi-, tri-, and multivalent, bi-, tri-, and multispecific and/or bi-, tri-, and multiparatopic polypeptides according to the invention may bind influenza subtype H1N1 as well as influenza subtype H3N2. In another aspect, the bi-, tri-, and multivalent, bi-, tri-, and multispecific and/or bi-, tri-, and multiparatopic polypeptides according to the invention may bind influenza subtype H5N1 as well as influenza subtype H2N2. In another aspect, the bi-, tri-, and multivalent, bi-, tri-, and multispecific and/or bi-, tri-, and multiparatopic polypeptides according to the invention may bind influenza subtype H5N1, influenza subtype H1N1 as well as influenza subtype H2N2. Yet in another aspect, the bi-, tri-, and multivalent, bi-, tri-, and multispecific and/or bi-, tri-, and multiparatopic polypeptides according to the invention may be directed against influenza virus and may bind influenza subtype H5N1, influenza subtype H1N1 as well as influenza subtype H3N2. Yet in another aspect, the bi-, tri-, and multivalent, bi-, tri-, and multispecific and/or bi-, tri-, and multiparatopic polypeptides according to the invention may be directed against influenza virus and may bind influenza subtype H5N1, influenza subtype H2N2 as well as influenza subtype H3N2. Yet in another aspect, the bi-, tri-, and multivalent, bi-, tri-, and multispecific and/or bi-, tri-, and multiparatopic polypeptides according to the invention may be directed against influenza virus and may bind influenza subtype H5N1, influenza subtype H1N1, influenza subtype H2N2, as well as influenza subtype H3N2. In another aspect, the bi-, tri-, and multivalent, bi-, tri-, and multispecific and/or bi-, tri-, and multiparatopic polypeptides according to the invention may bind rabies genotype 1 as well as genotype 5. In yet another aspect, the bi-, tri-, and multivalent, bi-, tri-, and multispecific and/or bi-, tri-, and multiparatopic polypeptides according to the invention may be directed against RSV and may bind different escape mutants of RSV (such as e.g. described in Lopez et al. 1998, J. Virol. 72: 6922-6928) and/or one or more escape mutants specific for antigen site II, specific for antigen site IV-VI or specific for the combination of both antigenic sites.

Finally, bi-, tri-, and multivalent, bi-, tri-, and multispecific and/or bi-, tri-, and multiparatopic polypeptides according to the invention may be useful in preventing and/or inhibiting viral infection and/or viral fusion of a virion with its target host cell (as defined herein) or may be useful in neutralizing a virus by inducing virion aggregation of said virus.

Generally, the amino acid sequences according to the present invention can be used to modulate, and in particular inhibit and/or prevent, the interaction between an envelope protein of a virus and a binding partner (e.g. viral receptor, target host cell, a particular cell membrane component or other binding partner, as applicable), and thus to modulate, and in particular inhibit, prevent or modulate viral-mediated biological pathway(s) in which an envelope protein of a virus and/or a viral receptor are involved. Thus, for example, when said envelope protein is part of a binding pair, the amino acid sequences and polypeptides may be such that they compete with the binding partner (e.g. viral receptor or other binding partner, as applicable) for binding to said envelope protein, and/or such that they (fully or partially) neutralize binding of the binding partner to the said envelope protein.

In this context, it is preferred that the amino acid sequences according to the invention can compete with a viral receptor of an envelope protein of a virus and/or with a target host cell for binding to said envelope protein.

When the amino acid sequences according to the invention compete with a target host cell for binding to said envelope protein, said amino acid sequences according to the invention may for example compete with particular cell membrane components of said target host cell, such as viral receptors, phospholipids, proteins, and/or glycoproteins, for binding to said envelope protein.

Viral receptors of enveloped proteins are known in the art and include but are not limited to the following examples: sialic acid, soluble (2,3) sialic acid, (2,6) sialic acid, CD4, CCR5, CXCR4, galactosylceramide, ACE2, HveA, CD155, ICAM-1, CAR, αv integrins, heparin sulphate proteoglycans, JAM-1, the Nicotinic Acetylcholine Receptor (AchR), the Neural Cell Adhesion Molecule (NCAM), and annexin II.

The amino acid sequences and polypeptides of the invention may compete with any of the foregoing viral receptors for binding to the envelope protein. Other examples of viral receptors will be clear to the skilled person; for instance, the amino acid sequences and polypeptides according to the invention may compete for binding to the envelope protein with any of the viral receptors that are disclosed in the handbook "Fields Virology", 5th edition (2007) by David M. Knipe, PhD; Peter M. Howley, MD; Diane E. Griffin, MD, PhD; Robert A. Lamb, PhD, ScD; Malcolm A. Martin, MD; Bernard Roizman, ScD; Stephen E. Straus, MD (ISBN-10: 0781760607; ISBN-13: 9780781760607).

The amino acid sequences according to the present invention can generally be used to modulate, and in particular inhibit and/or prevent, the interaction between an envelope protein of a virus and a viral receptor and/or the interaction between an envelope protein of a virus and a target host cell.

When the amino acid sequences according to the invention modulate, and in particular inhibit and/or prevent, the interaction between an envelope protein of a virus and a target host cell, said amino acid sequences according to the invention may for example modulate, and in particular inhibit and/or prevent, the interaction between an envelope protein of a virus and particular cell membrane components of said target host cell, such as viral receptors, phospholipids, proteins, and/or glycoproteins, for binding to said envelope protein.

In a preferred aspect, the amino acid sequences according to the present invention can generally be used to modulate, and in particular inhibit and/or prevent, the interaction between an envelope protein of a virus and a viral receptor. The amino acid sequences according to the present invention can generally be used to modulate, and in particular inhibit and/or prevent, the interaction between an envelope protein of a virus and a viral receptor wherein said interaction between an envelope protein and a viral receptor is chosen from the group consisting of the interaction of HA of influenza A virus with sialic acid; (2,3) sialic acid; and/or (2,6) sialic acid; the interaction of gp120 of HIV-1 virus with CD4; CCR5; CXCR4; and/or galactosylceramide; the interaction of S1 of SARS coronavirus with ACE2; the interaction of gD; gB; gC; the interaction of the heterodimer gH/gL of herpes simplex 1 virus and HveA; the interaction of VP1; VP2; VP3 of poliovirus 1 with CD155; the interaction of VP1; VP2; and/or VP3 of rhinovirus 3 with ICAM-1; the interaction of adenovirus 2 fibre with CAR; the interaction of adenovirus 2 penton base with αv integrins; sialic acid; (2,3) sialic acid; (2,6) sialic acid; and/or heparin sulphate proteoglycans; the interaction of σ1 of reovirus 1 with JAM-1; sialic acid; (2,3) sialic acid; and/or (2,6) sialic acid; and the interaction of G-protein of rabies virus with the Nicotinic Acetylcholine Receptor (AchR); and/or the Nueral Cell Adhesion Molecule (NCAM) (Thoulouze et al. 1998, J. Virol. 72: 7181-7190).

The amino acid sequences and polypeptides of the invention may generally be used to modulate, and in particular inhibit and/or prevent any of the foregoing interactions between an envelope protein of a virus and a viral receptor and/or between an envelope protein of a virus and particular cell membrane components of said target host cell, such as viral receptors, phospholipids, proteins, and/or glycoproteins.

Other examples of interactions between an envelope protein of a virus and a viral receptor will be clear to the skilled person; for instance, the amino acid sequences and polypeptides according to the invention may generally be used to modulate, and in particular inhibit and/or prevent any of the interactions between an envelope protein of a virus and a viral receptor that are disclosed in the handbook "Fields Virology", 5$^{th}$ edition (2007) by David M. Knipe, PhD; Peter M. Howley, MD; Diane E. Griffin, MD, PhD; Robert A. Lamb, PhD, ScD; Malcolm A. Martin, MD; Bernard Roizman, ScD; Stephen E. Straus, MD (ISBN-10: 0781760607; ISBN-13: 9780781760607).

In this context, the bi-, tri, and multiparatopic polypeptides according to the invention as described above, may compete with at least one, at least two or at least three (or even more) viral receptors of at least one or at least two (or even more) envelope proteins of a virus for binding to said envelope proteins.

Furthermore, the amino acid sequences and polypeptides according to the invention may also compete with at least one binding partner of an envelope protein of a virus (which is different from its natural viral receptor) for binding to said envelope protein. With at least one binding partner of an envelope protein is generally meant any molecule that is directed against and/or specifically binds to said envelope protein. For instance, a binding partner of an envelope protein can be an immunoglobulin, such as an antibody and can more specifically be a monoclonal antibody or any fragment thereof that can specifically bind said envelope protein. In this context, the amino acid sequences and polypeptides according to the invention may compete with a monoclonal antibody that is directed against and/or specifically binds to an envelope protein for binding to said envelope protein. For example, the amino acid sequences and polypeptides according to the invention may compete with the monoclonal antibody Synagis® (Zhao and Sullender J. Virol. 79: 396 (2005)) that is directed against and/or specifically binds to the A-antigenic site and/or amino acids 255 to 280 of the F-protein of RSV virus for binding to said F-protein of RSV virus; and/or the amino acid sequences and polypeptides according to the invention may compete with the monoclonal antibody 9C5 (Krivitskaia et al., Vopr. Virusol. 44: 279 (1999)) that is directed against and/or specifically binds to the Fla site and/or the region comprising amino acid 389 of the F-protein of RSV virus for binding to said F-protein of RSV virus; and/or the amino acid sequences and polypeptides according to the invention may compete with the Fab fragment 101F (Wu et al., J. Gen Virol. 88: 2719 (2007)) that is directed against and/or specifically binds to amino acids 422 to 438 of the F-protein of RSV virus for binding to said F-protein of RSV virus; and/or the amino acid sequences and polypeptides according to the invention may compete with the monoclonal antibody VN04-2 (Hanson et al. Respiratory Research 7: 126 (2006)) that is directed against and/or specifically binds to the sialic acid binding site of the hemagglutinin H5 envelope protein of influenza virus for binding to said hemagglutinin H5 envelope protein; and/or the amino acid sequences and polypeptides according to the invention may compete with the monoclonal antibody C179 (Okkuno et al. J. Virol. 67: 255202558 (1993)) that is directed against and/or specifically binds to the stem region of the hemagglutinin H5 envelope protein of influenza virus for binding to said hemagglutinin H5 envelope protein; and/or the amino acid sequences and polypeptides according to the invention may compete with the monoclonal antibody MAb 8-2 or mAb 8-2 a mouse IgG2alpha (Montaño-Hirose et al. *Vaccine* 11(12):1259-1266 (1993)) that is directed against and/or specifically binds to the G envelope protein of rabies virus for binding to said G envelope protein.

In this context, the bi-, tri- and multiparatopic polypeptides according to the invention as described above, may compete with at least one, at least two, at least three (or even more) binding partners of at least one, at least two, at least three (or even more) envelope proteins of a virus for binding to said envelope proteins, wherein said binding partners may be any molecules that are directed against and/or specifically bind to said envelope proteins, such as for instance, an immunoglobulin, such as an antibody and more specifically a monoclonal antibody or any fragment thereof that can specifically bind to said envelope protein. For instance, said bi-, tri- or multiparatopic polypeptides according to the invention may compete with the monoclonal antibody Synagis® (as described above) and/or the monoclonal antibody 9C5 (as described above) and/or the Fab fragment 101F Fab or any suitable combination thereof, for binding to the F-protein of RSV virus. Said bi-, tri- or multiparatopic polypeptides according to the invention may compete with VN04-2 and/or MAb C179 for binding the hemagglutinin H5 envelope protein of influenza virus. Said bi-, tri- or multiparatopic polypeptides according to the invention may compete with MAb 8-2 for binding to the G envelope protein of rabies virus.

The present invention is in its broadest sense also not particularly limited to or defined by a specific antigenic determinant, epitope, part, domain, subunit or conformation (where applicable) of an envelope protein of a virus against which the amino acid sequences and polypeptides of the invention are directed. For example, the amino acid sequences and polypeptides may or may not be directed against an "interaction site" (as defined herein).

However, it is generally assumed and preferred that the amino acid sequences and polypeptides of the invention are preferably directed against an interaction site (as defined herein), and in particular against at least one epitope of an envelope protein of a virus, such that at least one viral-mediated biological pathway in which an envelope protein of a virus and/or a viral receptor are involved is inhibited, prevented and/or modulated.

In particular, it is assumed and preferred that the amino acid sequences, polypeptides and compositions of the present invention are directed against at least one epitope of an envelope protein of a virus, such that viral entry in a target host cell (such as for instance virion attachment to a target host cell and/or viral fusion with a target host cell) and/or viral replication in a target host cell (such as for instance viral transcription and/or viral translation and/or viral packaging and/or the formation of functional virions and/or budding of nascent virions from the target host cell membrane) is inhibited, prevented and/or modulated.

The amino acid sequences and polypeptides may be directed against at least one epitope of an envelope protein of a virus that is surface-exposed or that is located in a cavity or cleft formed by an envelope protein of a virus. The amino acid sequences and polypeptides of the invention may be directed against an interaction site (as defined herein), and in particular against an epitope that is located in a cavity or cleft formed by a trimer of fusion proteins (such as a fusion protein trimer that is a trimer of hairpins or a six-helix bundle) or a dimer of fusion proteins, wherein said fusion proteins can be in their pre-, intermediate, or post-fusion conformational state.

Furthermore, the amino acid sequences and polypeptides of the invention may also be directed against an epitope that is located in the stem region and/or in the neck region and/or in the globular head region of a fusion protein. Preferably, the amino acid sequences and polypeptides of the invention are directed against an epitope that is located in the stem region of a fusion protein, such as for instance against an epitope that is located in the region comprising one or more of the amino acids 318 to 322 of the HA1 subunit of influenza HA and/or the region comprising one or more of the amino acids 47 to 58 of the HA2 subunit of influenza HA; against an epitope that is located in the N-terminal region comprising one or more of the amino acids 1 to 38 of the HA2 subunit of influenza HA; against an epitope that is located in the region comprising one or more of the amino acids 38 to 112 of the HA2 subunit of influenza HA; against an epitope that is located in the region comprising one or more of the amino acids 125 to 175 of the HA2 subunit of influenza HA; or against an epitope that is located in the region comprising one or more of the amino acids 176 to 185 of the HA2 subunit of influenza HA. Alternatively, the amino acid sequences and polypeptides of the invention may be directed against an epitope that is located in the globular head of a fusion protein (wherein said globular head may for example comprise a β-barrel-type structure or an immunoglobulin-type β-sandwich domain and a β-sheet domain).

Also, in particular, the amino acid sequences and polypeptides of the invention may preferably be directed against an interaction site, which is chosen from the group consisting of the A-antigenic site and/or amino acids 255 to 280 of the F-protein of RSV virus, the F1a site and/or the region comprising amino acid 389 of the F-protein of RSV virus, amino acids 422 to 438 of the F-protein of RSV virus, sialic acid binding site of the H5 HA envelope protein of influenza virus, the Nicotinic Acetylcholine Receptor (AchR) and/or the Nueral Cell Adhesion Molecule (NCAM) binding site of the G-protein of rabies virus (Thoulouze et al. 1998, J. Virol. 72: 7181-7190).

In one aspect of the invention the amino acids and polypeptides of the invention are directed against the Synagis® binding site on the RSV F protein and/or capable of competing with Synagis® for binding to the RSV F protein. In particular, they may be directed against antigenic site II (also referred to as site A) of the RSV F protein and more preferably against region aa 250-275 of the RSV F protein.

In another aspect of the invention the amino acids and polypeptides of the invention are directed against the 101F binding site on the RSV F protein and/or capable of competing with 101F for binding to the RSV F protein. In particular, they may be directed against antigenic site IV-VI of the RSV F protein and more preferably against region aa 423-436 of the RSV F protein.

In yet another aspect of the invention the amino acids and polypeptides of the invention are directed against the VN04-2 binding site on the hemagglutinin H5 envelope protein of influenza virus and/or capable of competing with VN04-2 for binding to the hemagglutinin H5 envelope protein of influenza virus.

In yet another aspect of the invention the amino acids and polypeptides of the invention are directed against the MAb 179 binding site on the hemagglutinin H5 envelope protein of influenza virus and/or capable of competing with MAb 179 for binding to the hemagglutinin H5 envelope protein of influenza virus.

In yet another aspect of the invention the amino acids and polypeptides of the invention are directed against the MAb 8-2 binding site on G envelope protein of rabies virus and/or capable of competing with MAb 8-2 for binding to the G envelope protein of rabies virus.

The amino acid sequences and polypeptides of the invention may also be directed against any epitope that is located in the C-terminal region of a fusion protein and/or in the N-terminal domain of a fusion protein and/or in or comprising the fusion peptide of a fusion protein and/or in the transmembrane domain of a fusion protein and/or in a α-helical coiled-coil of a fusion protein and/or in a β-structure of a fusion protein and/or in Domain I of a fusion protein and/or in Domain II of a fusion protein, such as for example in the fusion peptide of Domain II of a fusion protein, and/or in Domain III of a fusion protein, such as for example in the stem region at the C-terminus of Domain III of a fusion protein or in the transmembrane anchor at the C-terminus of Domain III of a fusion protein.

Also, the amino acid sequences and polypeptides of the invention may be directed against any other epitope of an envelope protein of a virus (for instance any other epitope that is close to one of the aforementioned epitopes).

Thus, in one preferred, but non-limiting aspect, the amino acid sequences and polypeptides of the invention are generally directed against any epitope or in particular against one of the above-mentioned epitopes of an envelope protein of a virus, and are as further defined herein. For example, said epitope may be present on an envelope protein of a virus that is chosen from the group consisting of the F protein of RSV virus, the G protein of RSV virus, the SH protein of RSV virus, the M protein of RSV virus, the M2 protein of RSV virus, the HA protein of influenza A virus, the gp120 protein of HIV-1 virus, the S1 protein of SARS Corona virus, the gD protein of Herpes simplex 1 virus, the VP1 and/or VP2 and/or VP3 proteins of Poliovirus 1, the VP1 and/or VP2 and/or VP3 proteins of Rhinovirus 3, fibre and/or penton base of Adenovirus 2, σ1 of Reovirus 1, the HEF protein of influenza C virus, the 5 F protein of Simian parainfluenza virus, the F protein of Human parainfluenza virus, the F protein of Newcastle disease virus, the F2 protein of measles, the F2 protein of Sendai virus, the gp2 protein of Ebola virus, the TM protein of Moloney murine leukemia virus, the gp41 protein of Human immunodeficiency virus 1, the gp41 protein of Simian immunodeficiency virus, the gp21 protein of Human T cell leukemia virus 1, the TM protein of Human syncytin-2, the TM protein of Visna virus, the S2 protein of Mouse hepatitis virus, the E2 protein of SARS corona virus, the E protein of Tick-borne encephalitis virus, the E2 protein of Dengue 2 and 3 virus, the E protein of Yellow Fever virus, the E protein of West Nile virus, the E1 protein of Semliki forest virus, the E1 protein of Sindbis virus, the G protein of Rabies virus, the G protein of Vesicular stomatitis virus and the gB protein of Herpes simplex virus.

Accordingly, the amino acid sequences and polypeptides of the invention may be directed against any epitope that is present on an envelope protein of a virus, which is chosen from the group consisting of the F protein of RSV virus, the G protein of RSV virus, the SH protein of RSV virus, the M protein of RSV virus, the M2 protein of RSV virus, the HA protein of influenza A virus, the gp120 protein of HIV-1 virus, the 51 protein of SARS Corona virus, the gD protein of Herpes simplex 1 virus, the VP1 and/or VP2 and/or VP3 proteins of Poliovirus 1, the VP1 and/or VP2 and/or VP3 proteins of Rhinovirus 3, fibre and/or penton base of Adenovirus 2, σ1 of Reovirus 1, the HEF protein of influenza C virus, the 5 F protein of Simian parainfluenza virus, the F protein of Human parainfluenza virus, the F protein of Newcastle disease virus, the F2 protein of measles, the F2 protein of Sendai virus, the gp2 protein of Ebola virus, the TM protein of Moloney murine leukemia virus, the gp41 protein of Human immunodeficiency virus 1, the gp41 protein of Simian immunodeficiency virus, the gp21 protein of Human T cell leukemia virus 1, the TM protein of Human syncytin-2, the TM protein of Visna virus, the S2 protein of Mouse hepatitis virus, the E2 protein of SARS corona virus, the E protein of Tick-borne encephalitis virus, the E2 protein of Dengue 2 and 3 virus, the E protein of Yellow Fever virus, the E protein of West Nile virus, the E1 protein of Semliki forest virus, the E1 protein of Sindbis virus, the G protein of Rabies virus, the G protein of Vesicular stomatitis virus and the gB protein of Herpes simplex virus.

It is also within the scope of the invention that, where applicable, an amino acid sequence of the invention can bind to two or more antigenic determinants, epitopes, parts, domains, subunits or conformations of said envelope protein of a virus. In such a case, the antigenic determinants, epitopes, parts, domains or subunits of said envelope protein of a virus to which the amino acid sequences and/or polypeptides of the invention bind may be essentially the same (for example, if said envelope protein of a virus contains repeated structural motifs or occurs in a multimeric form) or may be different (and in the latter case, the amino acid sequences and polypeptides of the invention may bind to such different antigenic determinants, epitopes, parts, domains, subunits of said envelope protein of a virus with an affinity and/or specificity which may be the same or different). Also, for example, when said envelope protein of a virus exists in an activated conformation and in an inactive conformation or a pre-fusion and post-fusion conformation or state, the amino acid sequences and polypeptides of the invention may bind to either one of these conformations or states, or may bind to both these conformations or states (i.e. with an affinity and/or specificity which may be the same or different).

It is also expected that the amino acid sequences and polypeptides of the invention will generally bind to all naturally occurring or synthetic analogs, variants, mutants, alleles, parts and fragments of said envelope protein of a virus; or at least to those analogs, variants, mutants, alleles, parts and fragments of said envelope protein of a virus that contain one or more antigenic determinants or epitopes that are essentially the same as the antigenic determinant(s) or epitope(s) to which the amino acid sequences and polypeptides of the invention bind to said envelope protein of a virus (e.g. in wild-type viral envelope proteins). Again, in such a case, the amino acid sequences and polypeptides of the invention may bind to such analogs, variants, mutants, alleles, parts and fragments with an affinity and/or specificity that are the same as, or that are different from (i.e. higher than or lower than), the affinity and specificity with which the amino acid sequences of the invention bind to (wild-type) said envelope protein of a virus. It is also included within the scope of the invention that the amino acid sequences and polypeptides of the invention bind to some analogs, variants, mutants, alleles, parts and fragments of said envelope protein of a virus, but not to others.

In a specific aspect of the invention, the amino acid sequences are multivalent (such as bivalent or trivalent) and show improved affinity and/or improved cross-reactivity for different genotypes, subtypes, viral escape mutants and/or strains of a certain virus compared to the monovalent amino acid sequence. In one aspect, the amino acid sequences are directed against influenza virus and may bind influenza subtype H5N1 as well as influenza subtype H1N1. In another aspect, the amino acid sequences are directed against influenza virus and may bind influenza subtype H5N1 as well as influenza subtype H3N2. In another aspect, the amino acid sequences are directed against influenza virus and may bind influenza subtype H1N1 as well as influenza subtype H3N2. In another aspect, the amino acid sequences are directed against influenza virus and may bind influenza subtype H5N1 as well as influenza subtype H2N2. Yet in another aspect, the amino acid sequences are directed against influenza virus and may bind influenza subtype H5N1, influenza subtype H1N1 as well as influenza subtype H3N2. Yet in another aspect, the amino acid sequences are directed against influenza virus and may bind influenza subtype H5N1, influenza subtype H2N2 as well as influenza subtype H3N2. Yet in another aspect, the amino acid sequences are directed against influenza virus and may bind influenza subtype H5N1, influenza subtype H1N1 as well as influenza subtype H2N2. Yet in another aspect, the amino acid sequences are directed against influenza virus and may bind influenza subtype H5N1, influenza subtype H1N1, influenza subtype H2N2 as well as influenza subtype H3N2. In another aspect, the amino acid sequences are directed against rabies virus and may bind rabies genotype 1 as well as genotype 5. In yet another aspect, the amino acid sequences are directed against RSV and may bind different strains of RSV (such as e.g. Long, A-2 and/or B-1). In yet another aspect, the amino acid sequences are directed against RSV and may bind different escape mutants of RSV (such as e.g. described in Lopez et al. 1998, J. Virol. 72: 6922-6928) and/or escape mutants specific for antigen site II, antigen site IV-VI or the combination of both antigenic sites.

When said envelope protein of a virus exists in a monomeric form and in one or more multimeric forms, it is within the scope of the invention that the amino acid sequences and polypeptides of the invention only bind to said envelope protein of a virus in monomeric form, only bind to said envelope protein of a virus in multimeric form, or bind to both the monomeric and the multimeric form. Again, in such a case, the amino acid sequences and polypeptides of the invention may bind to the monomeric form with an affinity and/or specificity that are the same as, or that are different from (i.e. higher than or lower than), the affinity and specificity with which the amino acid sequences of the invention bind to the multimeric form.

For example, when the envelope protein of a virus exists in a monomeric form and in a trimeric forms, it is within the scope of the invention that the amino acid sequences and polypeptides of the invention only bind to said envelope protein of a virus in monomeric form, only bind to said envelope protein of a virus in trimeric form, or bind to both the monomeric and the trimeric form. Again, in such a case, the amino acid sequences and polypeptides of the invention may bind to the monomeric form with an affinity and/or specificity that are the same as, or that are different from (i.e. higher than or lower than), the affinity and specificity with which the amino acid sequences of the invention bind to the trimeric form.

Also, when said envelope protein of a virus can associate with other proteins or polypeptides to form protein complexes (e.g. with multiple subunits), it is within the scope of the invention that the amino acid sequences and polypeptides of the invention bind to said envelope protein of a virus in its non-associated state, bind to said envelope protein of a virus in its associated state, or bind to both.

In all these cases, the amino acid sequences and polypeptides of the invention may bind to such multimers or associated protein complexes with an affinity and/or specificity that may be the same as or different from (i.e. higher than or lower than) the affinity and/or specificity with which the amino acid sequences and polypeptides of the invention bind to said envelope protein of a virus in its monomeric and non-associated state.

Also, as will be clear to the skilled person, proteins or polypeptides that contain two or more amino acid sequences directed against said envelope protein of a virus may bind with higher avidity to said envelope protein of a virus than the corresponding monomeric amino acid sequence(s). For example, and without limitation, proteins or polypeptides that contain two or more amino acid sequences directed against different epitopes of said envelope protein of a virus may (and usually will) bind with higher avidity than each of the different monomers, and proteins or polypeptides that contain two or more amino acid sequences directed against said envelope protein of a virus may (and usually will) bind also with higher avidity to a multimer (such as e.g. a trimer) of said envelope protein of a virus.

Generally, amino acid sequences and polypeptides of the invention will at least bind to those forms of said envelope protein of a virus (including monomeric, multimeric and associated forms) that are the most relevant from a biological and/or therapeutic point of view, as will be clear to the skilled person.

It is also within the scope of the invention to use parts, fragments, analogs, mutants, variants, alleles and/or derivatives of the amino acid sequences and polypeptides of the invention, and/or to use proteins or polypeptides comprising or essentially consisting of one or more of such parts, fragments, analogs, mutants, variants, alleles and/or derivatives, as long as these are suitable for the uses envisaged herein. Such parts, fragments, analogs, mutants, variants, alleles and/or derivatives will usually contain (at least part of) a functional antigen-binding site for binding against said envelope protein of a virus; and more preferably will be capable of specific binding to said envelope protein of a virus, and even more preferably capable of binding to said envelope protein of a virus with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein. Some non-limiting examples of such parts, fragments, analogs, mutants, variants, alleles, derivatives, proteins and/or polypeptides will become clear from the further description herein. Additional fragments or polypeptides of the invention may also be provided by suitably combining (i.e. by linking or genetic fusion) one or more (smaller) parts or fragments as described herein.

In one specific, but non-limiting aspect of the invention, which will be further described herein, such analogs, mutants, variants, alleles, derivatives have an increased half-life in serum (as further described herein) compared to the amino acid sequence from which they have been derived. For example, an amino acid sequence of the invention may be linked (chemically or otherwise) to one or more groups or moieties that extend the half-life (such as PEG), so as to provide a derivative of an amino acid sequence of the invention with increased half-life.

In one specific, but non-limiting aspect, the amino acid sequence of the invention may be an amino acid sequence that comprises an immunoglobulin fold or may be an amino acid sequence that, under suitable conditions (such as physiological conditions) is capable of forming an immunoglobulin fold (i.e. by folding). Reference is inter alia made to the review by Halaby et al. (1999, Protein Eng. 12: 563-71). Preferably, when properly folded so as to form an immunoglobulin fold, such an amino acid sequence is capable of specific binding (as defined herein) to said envelope protein of a virus; and more preferably capable of binding to said envelope protein of a virus with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein. Also, parts, fragments, analogs, mutants, variants, alleles and/or derivatives of such amino acid sequences are preferably such that they comprise an immunoglobulin fold or are capable for forming, under suitable conditions, an immunoglobulin fold.

In particular, but without limitation, the amino acid sequences of the invention may be amino acid sequences that essentially consist of 4 framework regions (FR1 to FR4 respectively) and 3 complementarity determining regions (CDR1 to CDR3 respectively); or any suitable fragment of such an amino acid sequence (which will then usually contain at least some of the amino acid residues that form at least one of the CDR's, as further described herein).

The amino acid sequences of the invention may in particular be an immunoglobulin sequence or a suitable fragment thereof, and more in particular be an immunoglobulin variable domain sequence or a suitable fragment thereof, such as light chain variable domain sequence (e.g. a $V_L$-sequence) or a suitable fragment thereof; or a heavy chain variable domain sequence (e.g. a $V_H$-sequence) or a suitable fragment thereof. When the amino acid sequence of the invention is a heavy chain variable domain sequence, it may be a heavy chain variable domain sequence that is derived from a conventional four-chain antibody (such as, without limitation, a $V_H$ sequence that is derived from a human antibody) or be a so-called $V_{HH}$-sequence (as defined herein) that is derived from a so-called "heavy chain antibody" (as defined herein).

However, it should be noted that the invention is not limited as to the origin of the amino acid sequence of the invention (or of the nucleotide sequence of the invention used to express it), nor as to the way that the amino acid sequence or nucleotide sequence of the invention is (or has been) generated or obtained. Thus, the amino acid sequences of the invention may be naturally occurring amino acid sequences (from any suitable species) or synthetic or semi-synthetic amino acid sequences. In a specific but non-limiting aspect of the invention, the amino acid sequence is a naturally occurring immunoglobulin sequence (from any suitable species) or a synthetic or semi-synthetic immunoglobulin sequence, including but not limited to "humanized" (as defined herein) immunoglobulin sequences (such as partially or fully humanized mouse or rabbit immunoglobulin sequences, and in particular partially or fully humanized $V_{HH}$ sequences or NANOBODIES® ($V_{HH}$ sequences)), "camelized" (as defined herein) immunoglobulin sequences, as well as immunoglobulin sequences that have been obtained by techniques such as affinity maturation (for example, starting from synthetic, random or naturally occurring immunoglobulin sequences), CDR grafting, veneering, combining fragments derived from different immunoglobulin sequences, PCR assembly using overlapping primers, and similar techniques for engineering immunoglobulin sequences well known to the skilled person; or any suitable combination of any of the foregoing. Reference is for example made to the standard handbooks, as well as to the further description and prior art mentioned herein.

Similarly, the nucleotide sequences of the invention may be naturally occurring nucleotide sequences or synthetic or semi-synthetic sequences, and may for example be sequences that are isolated by PCR from a suitable naturally occurring template (e.g. DNA or RNA isolated from a cell), nucleotide sequences that have been isolated from a library (and in particular, an expression library), nucleotide sequences that have been prepared by introducing mutations into a naturally occurring nucleotide sequence (using any suitable technique known per se, such as mismatch PCR), nucleotide sequence that have been prepared by PCR using overlapping primers, or nucleotide sequences that have been prepared using techniques for DNA synthesis known per se.

The amino acid sequence of the invention may in particular be a domain antibody (or an amino acid sequence that is suitable for use as a domain antibody), a single domain antibody (or an amino acid sequence that is suitable for use as a single domain antibody), a "dAb" (or an amino acid sequence that is suitable for use as a dAb) or a NANOBODY® ($V_{HH}$ sequence) (as defined herein, and including but not limited to a $V_{HH}$ sequence); other single variable domains, or any suitable fragment of any one thereof. For a general description of (single) domain antibodies, reference is also made to the prior art cited above, as well as to EP 0 368 684. For the term "dAb's", reference is for example made to Ward et al. (Nature 1989 Oct. 12; 341 (6242): 544-6), to Holt et al., Trends Biotechnol., 2003, 21(11):484-490; as well as to for example WO 06/030220, WO 06/003388 and other published patent applications of Domantis Ltd. It should also be noted that, although less preferred in the context of the present invention because they are not of mammalian origin, single domain antibodies or single variable domains can be derived from certain species of shark (for example, the so-called "IgNAR domains", see for example WO 05/18629).

In particular, the amino acid sequence of the invention may be a NANOBODY® ($V_{HH}$ sequence) (as defined herein) or a suitable fragment thereof [Note: NANOBODY® ($V_{HH}$ sequence), NANOBODIES® ($V_{HH}$ sequences) and NANOCLONE® are registered trademarks of Ablynx N.V.] Such NANOBODIES® ($V_{HH}$ sequences) directed against an envelope protein of a virus will also be referred to herein as "NANOBODIES® ($V_{HH}$ sequences) of the invention".

For a general description of NANOBODIES® ($V_{HH}$ sequences), reference is made to the further description below, as well as to the prior art cited herein. In this respect, it should however be noted that this description and the prior art mainly described NANOBODIES® ($V_{HH}$ sequences) of the so-called "$V_H3$ class" (i.e. NANOBODIES® ($V_{HH}$ sequences) with a high degree of sequence homology to human germline sequences of the $V_H3$ class such as DP-47, DP-51 or DP-29), which NANOBODIES® ($V_{HH}$ sequences) form a preferred aspect of this invention. It should however be noted that the invention in its broadest sense generally covers any type of NANOBODY® ($V_{HH}$ sequence) directed against an envelope protein of a virus, and for example also covers the NANOBODIES® ($V_{HH}$ sequences) belonging to the so-called "$V_H4$ class" (i.e. NANOBODIES® ($V_{HH}$ sequences) with a high degree of sequence homology to human germline sequences of the $V_H4$ class such as DP-78), as for example described in WO 07/118670.

Generally, NANOBODIES® ($V_{HH}$ sequences) (in particular $V_{HH}$ sequences and partially humanized NANOBODIES® ($V_{HH}$ sequences)) can in particular be characterized by the presence of one or more "Hallmark residues" (as described herein) in one or more of the framework sequences (again as further described herein).

Thus, generally, a NANOBODY® ($V_{HH}$ sequence) can be defined as an amino acid sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which one or more of the Hallmark residues are as further defined herein.

In particular, a NANOBODY® ($V_{HH}$ sequence) can be an amino acid sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which the framework sequences are as further defined herein.

More in particular, a NANOBODY® ($V_{HH}$ sequence) can be an amino acid sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

i) preferably one or more of the amino acid residues at positions 11, 37, 44, 45, 47, 83, 84, 103, 104 and 108 according to the Kabat numbering are chosen from the Hallmark residues mentioned in Table B-2 below;

and in which:

ii) said amino acid sequence has at least 80% amino acid identity with at least one of the amino acid sequences of SEQ ID NO's: 1 to 22, in which for the purposes of determining the degree of amino acid identity, the amino acid residues that form the CDR sequences (indicated with X in the sequences of SEQ ID NO's: 1 to 22) are disregarded.

In these NANOBODIES® ($V_{HH}$ sequences), the CDR sequences are generally as further defined herein.

Thus, the invention also relates to such NANOBODIES® ($V_{HH}$ sequences) that can bind to (as defined herein) and/or are directed against an envelope protein of a virus, to suitable fragments thereof, as well as to polypeptides that comprise or essentially consist of one or more of such NANOBODIES® ($V_{HH}$ sequences) and/or suitable fragments.

SEQ ID NO's 126 to 407, 2431 to 2448, 2574 to 2581, 2682 to 2717 and 3064 to 3128 (see Table A-1) give the amino acid sequences of a number of $V_{HH}$ sequences that have been raised against an envelope protein of a virus.

TABLE A-1

Preferred $V_{HH}$ sequences or NANOBODY® ($V_{HH}$ sequences)(also referred herein as a sequence with a particular name or SEQ ID NO: X, wherein X is a number referring to the relevant amino acid sequence):

| Name | SEQ ID NO: | Amino acid sequence |
|---|---|---|
| LG202A10 | 126 | EVQLVESGGGLVQAGDSLRLSCIDSGRTFSDYPIGWFRQAPGKEREFVAAI YAIGGDVYYADSVKGRFTISRDNAKNTVYLQMSSLKPEDTAIYSCAVASGG GSIRSARRYDYWGRGTQVTVSS |
| LG202A12 | 127 | EVQLVESGGGLVQAGGSLRLSCAASGGTFSSYAMGWFRQAPGKERDFVSAI TWSGGSTYYADSVKGRFTISRDNAKNTVYLQMNSLKPEDTAVYYCAADDQK YDYIAYAEYEYDYWGQGTQVTVSS |
| LG202A5 | 128 | EVQLVESGGDLVQPGGSLRLSCAASGFTFRGYWMTWVRQAPGKGLEWVSSI NNIGEEAYYVDSVKGRFTISRDNAKNTLYLQMNSLKSEDTAVYYCVKDWAS DYAGYSPNSQGTQVTVSS |
| LG202A9 | 129 | EVQLVESGGGSVQPGGSLRLSCAASGFTFRGYWMSWVRQAPGKGLEWVSAI NNVGGDTYYADSVKGRFTISRDNAKNMLYLQMNSLKAEDTAVYYCARDWHN DPNKNEYKGQGTQVTVSS |
| LG202B10 | 130 | EVQLVESGGGLVQPGGSLRLSCAASGFTFRGYWMSWVRQAPGKGLEWVSAI NNVGDEVYYADSVKGRFTISRDNAKNTLYLQMNSLKSEDTAVYYCTRDWYN DPNKNEYKGQGTQVTVSS |
| LG202B7 | 131 | EVQLVESGGGLVQPGGSLRLSCAASGFTFRGYWMSWVRQAPGKGLEWVSAI NNVGDEVYYADSVKGRFTISRDNAKNTLYLQMNSLKSEDTAVYYCTRDWFD DPNKNEYKGQGTQVTVSS |
| LG202B8 | 132 | EVQLVESGGGLVQPGGSLRLSCAASGFTFSGYWMSWVRQAPGKGLEWVSAI SNSGGETYYADSVKGRFTISRDNAKNTLYLQMNSLRSEDTAVYYCTRDWHS DPNKHEYRGQGTQVTVSS |
| LG202B9 | 133 | EVQLVESGGGSVQPGGSLRLSCAASGFTFRGYWMSWVRQAPGKGLEWVSAI NNLGGDTYYADSVKGRFTISRDNAKNMLYLQMNSLKAEDTAVYYCARDWYD DPNKNEYKGQGTQVTVSS |
| LG202C1 | 134 | KVQLVESGGDLVQPGGSLRLSCAASGFTFRGYWMTWVRQAPGKGLEWVSSI NNIGEEAYYVDSVKGRFTISRDNAKNTLYLQMNSLKSEDTAVYYCVKDWAS DYAGYSPNSQGTQVTVSS |
| LG202C11 | 135 | EVQLVESGGGSVQPGGSLRLSCAASGFTFRGYWMSWVRQAPGKGLEWVSAI NNVGGDTYYADSVKGRFTISRDNAKNMLYLQMNSLKAEDTAVYYCARDWHN DPNKNEYKGQGTQVTVSS |
| LG202C2 | 136 | EVQLVESGGDLVQPGGSLRLSCAASGFTFRGYWMTWVRQAPGKGLEWVSSI NNIGEEAYYVDSVKGRFTISRDNAKNTLYLQMNSLKSEDTAVYYCVKDWAS DYAGYSPNSQGTQVTVSS |

TABLE A-1-continued

Preferred $V_{HH}$ sequences or NANOBODY® ($V_{HH}$ sequences)(also referred herein as a sequence with a particular name or SEQ ID NO: X, wherein X is a number referring to the relevant amino acid sequence):

| Name | SEQ ID NO: | Amino acid sequence |
|---|---|---|
| LG202C7 | 137 | EVQLVESGGGLVQPGGSLRLSCAASGFTFSGYWMSWVRQAPGKGLEWVSAI NNVGDETYYANSVKGRFTIARDNTKRTLYLQMNSLKSEDTAVYYCTRDWHS EPNKYEYKGQGTQVTVSS |
| LG202C8 | 138 | EVQLVESGGGLVQPGGSLRLSCTGSGFTFSSYWMDWVRQTPGKDLEYVSGI SPSGSNTDYADSVKGRFTISRDNAKNTLYLQMNSLKPEDTALYYCRRSLTL TDSPDLRSQGTQVTVSS |
| LG202C9 | 139 | EVQLVESGGGLVQPGGSLRLSCAASGFTFRGYWMSWVRQAPGKGLEWVSAI NNVGGETYYADSVKGRFTISRDNAKNALYLQMNSLKSEDTAVYYCARDWYN DPNKNEYKGQGTQVTVSS |
| LG202D5 | 140 | EVQLVESGGGLVQAGGSLRLSCAASGSTGSSTAMGWSRQAPGKQREWVASI SSAGTIRYVDSVKGRFTISRDNAKNTGYLQMNSLKPEDTAVYYCYVVGNFT TYWGRGTQVTVSS |
| LG202D7 | 141 | EVQLVESGGGSVQPGGSLRLSCAASGFTFRGYWMSWVRQAPGKGLEWVSAI NNLGGDTYYADSVKGRFTISRDNAKNMLYLQMNSLKAEDTAVYYCARDWYD DPNKNEYKGQGTQVTVSS |
| LG202D8 | 142 | EVQLVESGGGLVQPGGSLRLSCAASGFTFRGYWMSWVRQAPGKGLEWVSAI NNVGDEVYYADSVKGRFTISRDNAKNTLYLQMNSLKSEDTAVYYCTRDWYN DPNKNEYKGQGTQVTVSS |
| LG202E11 | 143 | EVQLVESGGGLVQPGGSLRLSCAASGFTFRGYWMSWVRQAPGKGLEWVSAI NNVGDEVYYADSVKGRFTISRDNAKNTLYLQMNSLKSEDTAVYYCTRDWYN DPNKNEYKGQGTQVTVSS |
| LG202E2 | 144 | EVQLVESGGGLVQPGGSLRLSCAASGFTFGGYWMTWVRQAPGKGLEWVSSI ANDGKSTYYVDSVKGRFSISRDNAKNTLYLQMNSLKSEDTAVYYCVRDWAS DYAGYSPNSQGTQVTVSS |
| LG202E5 | 145 | EVQLVESGGDLVQPGGSLRLSCAASGFTFRGYWMTWVRQAPGKGLEWVSSI NNIGEETYYVDSVKGRFTISRDNAKNTLYLQMNSLKSEDTAVYYCVKDWAS DYAGYSPNSQGTQVTVSS |
| LG202E6 | 146 | EVQLVESGGGLVQAGGSLRLSCAASGRTFSSYAMGWFRQAPGKEREFVAAI SWSGRTTYYADFVKGRFTISRDNAKNTVYLQMNSLKPEDTAVYYCAADLSP GNEYGEMMEYEYDYWGEGTQVTVSS |
| LG202E7 | 147 | EVQLVESGGGLVQPGGSLRLSCAASGFTFRGYWMSWVRQAPGKGLEWVSAI NNVGGETYYADSVKGRFTISRDNAKNTLYLQMNSLKSEDTAAYYCARDWYN DPNKNEYKGQGTQVTVSS |
| LG202F10 | 148 | EVQLVESGGGSVQPGGSLRLSCAASGFTFRGYWMSWVRQAPGKGLEWVSAI NNLGGDTYYADSVKGRFTISRDNAKNMLYLQMNSLKAEDTAVYYCARDWYD DPNKNEYKGQGTQVTVSS |
| LG202F12 | 149 | EVQLVESGGGLVQPGGSLRLSCAASGFTFSGYWMSWVRQAPGKGLEWVSAI NNVGGDTYYADSVKGRFTISRDNAKNTLYLQMNSLKSEDTAVYYCARDWYN DPNKNEYKGQGTQVTVSS |
| LG202F3 | 150 | EVQLVESGGDLVQPGGSLRLSCAASGFTFRGYWMTWVRQAPGKGLEWVSSI NNIGEEAYYVDSVKGRFTISRDNAKNTLYLQMNSLKSEDTAVYYCVKDWAS DYAGYSPNSQGTQVTVSS |
| LG202F4 | 151 | EVQLVESGGDLVQPGGSLRLSCAASGFTFRGYWMTWVRQAPGKGLEWVSSI NNIGEEAYYVDSVKGRFTISRDNAKNTLYLQMNSLKSEDTAVYYCVKDWAS DYAGYSPNSQGTQVTVSS |
| LG202F8 | 152 | EVQLVESGGGLVQPGGSLRLSCAASGLIFSSYDMGWFRQAPGEERAFVGAI SRSGDVRYVDPVKGRFTITRDNAKNTVYLQMNSLKPEDTAVYYCAADADGW WHRGQAYHWWGQGTQVTVSS |
| LG202G11 | 153 | EVQLVESGGGLVQPGGSLRLSCAASGFTFRGYWMSWVRQAPGKGLEWVSAI NNVGGETYYADSVKGRFTISRDNAKNTLYLQMNSLKSEDTAAYYCARDWYN DPNKNEYKGQGTQVTVSS |
| LG202G3 | 154 | EVQLMESGGGLVQAGGSLRLSCAASGRTFSGYTMGWFRQAPGKGREWVAGI SWSGDSTYYADSVKGRFTISREDAKNTVYLQMNSLKPGDTADYYCAAECAM YGSSWPPPCMDWGQGTQVTVSS |

TABLE A-1-continued

Preferred $V_{HH}$ sequences or NANOBODY® ($V_{HH}$ sequences)(also referred herein as a sequence with a particular name or SEQ ID NO: X, wherein X is a number referring to the relevant amino acid sequence):

| Name | SEQ ID NO: | Amino acid sequence |
|---|---|---|
| LG202G8 | 155 | EVQLVESGGGSVQPGGSLRLSCAASGFTFRGYWMSWVRQAPGKGLEWVSAINNLGGDTYYADSVKGRFTISRDNAKNMLYLQMNSLKAEDTAVYYCARDWYDDPNKNEYKGQGTQVTVSS |
| LG202H2 | 156 | EVQLVESGGDLVQPGGSLRLSCAASGFTFSGYWMTWVRQAPGKGLEWVSSINNIGEEVYYVDSVKGRFTISRDNAKNTLYLQMNSLKSEDTAVYYCVKDWASDYAGYSPNSQGTQVTVSS |
| LG202H8 | 157 | EVQLVESGGGSVQPGGSLRLSCAASGFTFRGYWMSWVRQAPGKGLEWVSAINNVGGDTYYADSVKGRFTISRDNAKNMLYLQMNSLKAEDTAVYYCARDWHNDPNKNEYKGQGTQVTVSS |
| LG191B9 | 158 | EVQLVESGGGLVQAGGSLRLSCAASGRTFSSSFMAWFRQVLGSDREFVGGISPGGRFTYYADSRKGRFTISGDNANNTVYLQMHSVKPEDTATYYCAADTQFSGYVPKETNEYDYWGQGTQVTVSS |
| LG191D3 | 159 | EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSS |
| LG192A8 | 160 | EVQLVESGGGLVQAGGSLRLSCAASERTVIAYTMGWFRRAPGKERDFVAAMNWNGGNTIYADSAKGRFTISRDNAKNTVYLQMNSLKAEDTAVYYCAARPRFWGSYEYDYWGQGTQVTVSS |
| LG192B1 | 161 | EVQLVESGGGLVQPGGSLRLSCAASGLTFRNYAIGWFRQAPGKEREGVSCINSGGSITDYLDSVKGRFAISRDNAKSTVYLQMNSLKPEDTAVYYCATDLTSSCPIYSGTDYWGKGTLVTVSS |
| LG192C10 | 162 | EVQLVESGGGLVQAGGSLRLSCAASEGYFRNYMVGWFRQAPGGERMFVAAISDTAYYADSVKGRFTISRDNAKNTVYLPMNSLKPEDTAVYYCAAAPKSWGTWPLVADTRSYHFWGQGTQVTVSS |
| LG192C4 | 163 | EVQLVESGGGLVQAGGSLRLSCEASGRTFSSYAMVGWFRQAPGKEREFVAAVTRWSGARTVYADSVKGRFTISRDNAENTVYLQMNSLKPEDTAVYTCAADSTNRNSGAVYYSWAYDYWGQGTQVTVSS |
| LG192C6 | 164 | EVQLVESGGGLVQAGGSLRLSCEASGRTERYQAMGWFRQAPGKEREFVAVVTRWSGARTVYADSVKGRFTISRDNAENTVYLQMNSLKPEDTAVYTCAADSTNRNRGAIYYTWAYDYWGQGTQVTVSS |
| LG192D3 | 165 | EVQLVESGGGLVQAGGSLRLSCATSGRTRSRYTMGWFRQAPGKEREFVAAISWSDDSTYYRDSVKGRFTISRDNAKKTVYLQMNTLKPEDTAVYYCAADSAFGTGYSDNYYSTSEEYDYWGQGTQVTVSS |
| LG191E4 | 166 | EVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSS |
| LG192F2 | 167 | EVQLVESGGGLVQAGGSLRLSCEASGRTFSPIAMGWFRQAPGKEREFVAVVTRWSGARTVYADSVKGRFTISRDNAENTVYLQMNSLKPEDTAVYTCAADSTNRNSGAIYYTWAYDYWGQGTQVTVSS |
| LG192H1 | 168 | EVQLVESGGGLVQAGGSLRLSCAASGIIFSTNHMGWYRRAPGKQRELVGTINRGDSPYYADSVKGRFTISRDNAKNMVYLQMNSLKPEDTAVYYCNAGYIYWGQGTQVTVSS |
| LG192H2 | 169 | EVQLVESGGGLVQAGGSLRLSCEASGRTFSNYAMGWFRQAPGKEREFVAVVTRWSGGRTVYADSVKGRFTISRDNAENTVYLQMNSLKPEDTAVYTCAADSTNRNSGAWYYTWAYDHWGQGTQVTVSS |
| LG20610B | 170 | EVQLVESGGGLVQAGGSLRLSCTASGRTFSSYAMGWFRQTPGKEREFVASISWIGKFTYYADSVKGRFTISGENAKNTVYLQMNSLKPEDTAVYYCAAKTLVGVTTAFDRWGQGTQVTVSS |
| LG20610C | 171 | EVQLVESGGGLVQTGGSLRLSCAASGRTFSSSFMAWFRQALGSDREFVGGISPGGRITYYADSRKGRFTISRDNANNTVYLQMDSLKPEDTATYYCAADTQYSGVVLKESTDYDYWGQGTQVTVSS |
| LG20610D | 172 | EVQLVESGGGLVQTGGSLRLSCAASGRTFSSSFMAWFRQALGSDREFVGGISPGGRITYYADSRKGRFTISRDNANNTVYLQMDSLKPEDTATYYCAADTQYSGVVLKESTDYDYWGQGTQVTVSS |

TABLE A-1-continued

Preferred $V_{HH}$ sequences or NANOBODY® ($V_{HH}$ sequences)(also referred herein as a sequence with a particular name or SEQ ID NO: X, wherein X is a number referring to the relevant amino acid sequence):

| Name | SEQ ID NO: | Amino acid sequence |
|---|---|---|
| LG20610E | 173 | EVQLVESGGGLVQAGGSLRLSCAASVRTFSNGAMGWFRQAPGKEREFVASI SWSGGSTYYADSVKGRFTISGDNAKSTVYLQMNSLKPEDTAVYYCAVRGVA VTTILWNYWGQGTQVTVSS |
| LG20610F | 174 | EVQLVESGGGLVQAGGSLRLSCAASERTVIAYTMGWFRRAPGKERDFVAAM NWNGGNTIYADSAKGRFTISRDNAKNTVYLQMNSLKAEDTAVYYCAARPRF WGSYEYDYWGQGTQVTVSS |
| LG20611D | 175 | EVQLVESGGGLVQAGGSLRLSCAASERTVIAYTMGWFRRAPGKERDFVAAM NWNGGNTIYADSAKGRFTISRDNAKNTVYLQMNSLKAEDTAVYYCAARPRF WGSYEYDYWGQGTQVTVSS |
| LG20611H | 176 | EVQLVESGGGLVQAGGSLRLSCAASEGYFRNYMVGWFRQAPGGERMFVAAI SDTAYYADSVKGRFTISRDNAKNTVYLPMNSLKPEDTAVYYCAAAPKSWGT WPLVADTRSYHFWGQGTQVTVSS |
| LG20612F | 177 | EVQLVESGGGLVQAGGSLRLSCAASEGYFRNYMVGWFRQAPGGERMFVAAI SDTAYYADSVKGRFTISRDNAKNTVYLPMNSLKPEDTAVYYCAAAPKSWGT WPLVADTRSYHFWGQGTQVTVSS |
| LG2062A | 178 | EVQLVESGGGLVQAGGSLRLSCEASGRTFSNYAMGWFRQAPGKEREFVAVV TRWSGGRTVYADSVKGRFTISRDNAENTVYLQMNSLKPEDTAVYTCAADST NRNSGAWYYTWAYDHWGQGTQVTVSS |
| LG2062C | 179 | EVQLVESGGELVQAGDSLTVSCAASGRTFSVYTMGWFRQAPMKEREFVAAI SGGSIRYADSVKGRFAISSDNAGNTVYLQMNNLQPEDTAVYYCAAQGSIVF YSNWDRASQYDYWGQGTQVTVSS |
| LG2062E | 180 | EVQLVESGGGLVQPGGSLRLSCAASGFTFSSYWMYWVRQAPGKGLEWVSAI STGGGDTHYADSVKGRFTISRDNPKNTLYLQMNSLKPEDTALYYCARNRDS GSSYITFSLADFGSWGQGTQVTVSS |
| LG2062F | 181 | EVQLVESGGGLVQAGGSLRLSCEASGRTYSRYGMGWFRQAPGKEREFVAAV SRLSGPRTVYADSVKGRFTISRDNAENTVYLQMNSLKPEDTAVYTCAAELT NRNSGAYYYAWAYDYWGQGTQVTVSS |
| LG2062G | 182 | EVQLVESGGGLVQPGGSLRLSCAASGSSFSINAMGWFRQAPGKEREFVAVV TRWSGARTVYADSVKGRFTISRDNAENTVYLQMNSLKPEDTAVYTCAADST NRNSGAVYYTWAYDYWGQGTQVTVSS |
| LG2062H | 183 | EVQLVESGGGLVQPGGSLRLSCAASGSSFSINAMGWFRQAPGKEREFVAVV TRWSGARTVYADSVKGRFTISRDNAENTVYLQMNSLKPEDTAVYTCAADST NRNSGAVYYTWAYDYWGQGTQVTVSS |
| LG2063A | 184 | EMQLVESGGGLVQAGGSLRLSCEASGRSFSSYAMGWFRQAPGKEREFVAAV SRWSGPRTVYADSVKGRFTISRDNAENTVYLQMNSLKPEDTAVYTCAADST NRNSGAVYYTWAWDYWGQGTQVTVSS |
| LG2063B | 185 | EVQLVESGGGLVQAGGSLRLSCAASGFTFDDYAIGWFRQAPGKEREGVSCI RCSDGSTYYADSVKGRFTISSDNAKNTVYLQMNSLKPEDTAVYYCAADFSL AQYKTIHRMPPYGMDYWGKGTLVTVSS |
| LG2063C | 186 | EVQLVESGGGLVQAGGSLRLSCEASGGSFSSYAMGWFRQAPGKEREFVAAV SGWIGPRPVYADSVKGRFTISRDNAENTVYLQMNSLQPEDTAVYTCAADAT NRNSGAYYYTWAYDYWGQGTQVTVSS |
| LG2063D | 187 | EVQLVESGGGLVQAGGSLRLSCEASGRSFSSVAMGWFRQAPGKEREFVAAL SRWSGARTVYADSVKGRFTISGDNAENTVYLQMNSLKPEDTAVYTCAADST NRNSGAVYYTWAYDYWGQGTQVTVSS |
| LG2063E | 188 | EVQLVESGGGLVQAGGSLRLSCEASGRTFSSYAMGWFRQAPGKEREFVAVV TRWSGGRTVYABSVKGRFTISRDNAENTVYLQMNSLKPEDTAVYTCAADST NRNSGAWYYTWAYDHWGQGTQVTVSS |
| LG2063F | 189 | EVQLVESGGGLVQAGGSLRLSCEASGRTFSRYGMGWFRQAPGKEREFVAAV SRLSGPRTVYADSVKGRFTISRDNAENTVYLQMNSLKPEDTAVYTCAAELT NRNSGAYYYTWAYDYWGQGTQVTVSS |
| LG2064D | 190 | EVQLVESGGGLVQAGGSLRLSCEASGRTFSPIAMGWFRQAPGKEREFVAVV TRWSGARTVYADSVKGRFTISRDNAENTVYLQMNSLKPEDTAVYTCAADST NRNSGAIYYTWAYDYWGQGTQVTVSS |

TABLE A-1-continued

Preferred $V_{HH}$ sequences or NANOBODY® ($V_{HH}$ sequences)(also referred herein as a sequence with a particular name or SEQ ID NO: X, wherein X is a number referring to the relevant amino acid sequence):

| Name | SEQ ID NO: | Amino acid sequence |
|---|---|---|
| LG2064G | 191 | EVQLVESGGGLVQAGGSLRLSCEASGRTFSSVAMGWFRQAPGKEREFVAAVSRWSGARTVYADSVKGRFTISGDNAENTVYLQMNSLKPEDTAVYTCAADSTNRNSGAVYYPWAYDYWGQGTQVTVSS |
| LG2065A | 192 | EVQLVESGGGLVQAGGSLRLSCEASRRTFSSYAMVGWFRQAPGKEREFVAAVTRWSGARTVYADSVKGRFTISRDNAENTVYLQMNSLKPEDTAVYTCAADSTNRNSGAVYYSWAYDYWGQGTQVTVSS |
| LG2065E | 193 | EVQLVESGGGLVQAGGSLRLSCEASGRTERYQAMGWFRQAPGKEREFVAVVTRWSGARTVYADSVKGRFTISRDNAENTVYLQMNSLKPEDTAVYTCAADSTNRNSGAIYYTWAYDYWGQGTQVTVSS |
| LG2066A | 194 | EVQLVESGGGLVQAGGSLRLSCEASGRTFSSYAMVGWFRQAPGKEREFVAAVTRWSGARTVYADSVKGRFTISRDNAENTVYLQMNSLKPEDTAVYTCAADSTNRNSGAVYYSWAYDYWGQGTQVTVSS |
| LG2066D | 195 | EVQLVESGGGLVQPGGSLGLSCAASGNIFSITGMGWYRQAPGNQRELVAQISHYDSTMYADSVKGRFTISRDNAKNTVYLQMNSLKPEDTAVYYCNAQIIPRVMPLRSNDYWGQGTQVTVSS |
| LG2067B | 196 | EVQLVESGGGSVQPGGSARLSCAVLGSIGSLNAMGWYRQTPGKERELVARITSLGPIMYAEFVKGRFTISRDNDKNTVYLQMNSLKPEDTAVYYCKTRWYEGIWREYWGQGTRVTVSS |
| LG2067C | 197 | EVQLVESGGGLAQPGGSLRLSCAASGFTFNDYAMGWFRQAPGKEREFVAGISWAGHNTVYAGSMKGRFTVSRDNAENTLYLQMNSLESEDTAVYYCAKSLGTIWYQKDYRAYDAWGRGTQVTVSS |
| LG2067E | 198 | EVQLVESGGGLVQAGGSLRLSCAASERTVIAYTMGWFRRAPGKERDFVAAMNWNGGNTIYADSAKGRFTISRDNAKNTVYLQMNSLKAEDTAVYYCAARPRFWGSYEYDYWGQGTQVTVSS |
| LG2067G | 199 | EVQLVESGGGLVQAGGSLRLSCAASERTFIPYPMGWFRQAPGKEREFVGAISGGGFPTFYADSVKGRFTISRDNAENTVYLQMNSLKPEDTAVYFCARNRQGEVFRTTRLDYDSWGRGTQVTVSS |
| LG2067H | 200 | EVQLVESGGGLVQPGGSLRLSCAASGFVFSHYAMSWVRQAPGKGLEWVSDITHGGLSTTYRDSVKGRFTISRDNAKNTLYLQMDSLKPEDTAVYYCSKDRYPFVSREYDYRGQGTQVTVSS |
| LG20711A | 201 | EVQLVESGGGLVQPGGSLTLSCAASGSVFSVNAMGWHRQAPGKERELVAQLTVFGSLNYADSVKGRFSISKDSAKNTVLLQMNSLKPEDTAVYSCNLRQYESDRWRDYWGQGTQVTVSS |
| LG20711B | 202 | EVQLVESGGGLVQPGGSLRLSCAASGFTFDYYAIGWFRQAPGKEREGVSCISSSDSSTYYADSVKGRFTISRDNAKNTVYLQMNSLKPEDTAVYYCAADFSRSWGTCNEEYYYGMDYWGKGTLVTVSS |
| LG20711D | 203 | EVQLVESGGGLVQAGGSLRLSCTASGRTLSSYAMGWFRQTPGKEREFVASISWIGKFTYYADSVKGRFTISGENAKNTVYLQMNSLKPEDTAVYYCAAKTIVGGTTAWBRWGQGTQVTVSS |
| LG20711E | 204 | EVQLVESGGGLVQAGGSLRLSCTAGGDTFSSYAMGWFRQTPGKEREFVASISWIGKFTYYADSVKGRFTISGENAKNTVYLQMNSLKPEDTAVYYCAAKTIVGGTTAWDRWGQGTQVTVSS |
| LG20711F | 205 | EVQLVESGGGLVQPGGSLRLSCAASGFVFSHYAMSWVRQAPGKGLEWVSDITNGGLSTTYRDSVKGRFTISRDNAKNTLYLQMDSLKPEDTAVYYCSKDLYPFVSREYDYRGQGTQVTVSS |
| LG20711G | 206 | EVQLVESGGGLVQAGGSLRLSCAAPGRTFSTWVMGWFRQAPGKEREFVARIDWGGSSTSYADIVKGRFTISRDNAKNTVYLQMNSLKPEDAAVYYCAADLDGNGSIDYGYEYWGQGTQVTVSS |
| LG20711H | 207 | EVQLVESGGGLVQPGGSLRLSCAASGFVFSHYAMSWVRQAPGKGLEWVSBITHGGLTTTYRDSVKGRFTISRDNAKNTLYLQMDSLKPEDTAVYYCSKDRYPFISKEYDYRGQGTQVTVSS |
| LG2071A | 208 | EVQMVESGGGLVQPGGSLRLSCVASGSIARLNTMGWYRQAPGKQRELVATLSIFGVSDYADSVKGRFTISRDNAKNMVYLQMNSLKPEDTALYFCKQRQHDGGSWYDYWGQGTQVTVSS |

TABLE A-1-continued

Preferred $V_{HH}$ sequences or NANOBODY® ($V_{HH}$ sequences)(also referred herein as a sequence with a particular name or SEQ ID NO: X, wherein X is a number referring to the relevant amino acid sequence):

| Name | SEQ ID NO: | Amino acid sequence |
|---|---|---|
| LG2071B | 209 | EVQLVESGGGLVQAGGSLRLSCAASGSLFRIFTMGWYRQAPGKQRELVADI TTGGSTNYADSVKGRFTISSENAKNTVYLQMNSLKAEDTAVYYCNALGRMA VAHSVSDFNSWGQGTQVTVSS |
| LG2071C | 210 | EVQLVESGGGLVQAGGSLRLSCAASGPTFSADTMGWFRQAPGKEREFVATI PWSGGIAYYSDSVKGRFTMSRDNAKNTVDLQMNSLKPEDTALYYCAGSSRI YIYSDSLSERSYDYWGQGTQVTVSS |
| LG207D1 | 211 | EVQLVESGGGLVQAGGSLRLSCEASGRTFSSYGMGWFRQAPGKEREFVAAV SRLSGPRTVYADSVKGRFTISRDNAENTVYLQMNSLKPEDTAVYTCAAELT NRNPGAYYYTWAYDYWGQGTQVTVSS |
| LG2071E | 212 | EVQLVESGGGLVQAGGSLRLSCAASGPTFSTMGWFRQAPGKEREFVATIPW SGGIPYYSDSVKGRFTMSRDNAKNTADLQMNSLKPEDTALYYCAGSSRIYI YSDSLSEGSYDYWGQGTQVTVSS |
| LG2071F | 213 | EVQLVESGGGLVQAGGSLRLSCAASGPTFSADTMGWFRQAPGKEREFVATI PWSGGIAYYSDSVKGRFTMSRDNAKNTVDLQMNSLKPEDTALYYCAGSSRI YIYSDSLSERSYDYWGQGTQVTVSS |
| LG2074A | 214 | EVQLVESGGGLVQPGGSLRLSCAASGSIFSINAMGWYRQAPGKQRDLVAHI TFGGSSYYADSVKGRFTISRDNAKNTVYLQMNSLKPEDTAVYYCNARGLGS HRVSDYWGQGTQVTVSS |
| LG2074B | 215 | EVQLVESGGGLVQPGGSLRLSCAASGSIFSINAMGWYRQAPGKQRDLVAHI TFGGNSYYADSVKGRFTISRDNAKNTVYLQMNSLKPEDTAVYYCNARGLGS HRVSDYWGQGTQVTVSS |
| LG2074D | 216 | EVQLVESGGGLVQAGGSLRLSCVASGRTFNNLAMGWFRQARGKEREFVATI SWSHPNTYYTDSVKGRFTISRDDAKNAVYLQMNSLKPEDTAVYYCAANPSY VYSDYLSLAGYTYWGQGTQVTVSS |
| LG2074H | 217 | EVQLVESGGGLVQAGGSLRLSCAASGSSGVINAMAWHRQAPGKERELVAHI SSGGSTYYGDFVKGRFTISRDNAKDTVYLQMNSLKPEDTAVYYCHVPWMDY NRRDYWGQGTQVTVSS |
| LG2075A | 218 | EVQLVESGGGLVQAGGSLRLSCAASGSLFRIFTMGWYRQAPGKQRELVADI TTGGSTNYADSVKGRFTISSENAKNTVYLQMNSLKAEDTAVYYCNALGRMA VAHSVSDFNSWGQGTQVTVSS |
| LG2075B | 219 | EVQLVESGGGLVQPGGSLRLSCAASGSIFSINAMGWYRQAPGKQRELVAHI SSGGSTYYGDSVKGRFTISRDNAKNTADLQMNSLKPEDTAVYYCNARTLGA HGIDDYWGQGTQVTVSS |
| LG2075C | 220 | EVQLVESGGGLVQAGGSLRLSCAASGPTFSADTMGWFRQAPGKEREFVATI PWSGGIAYYSDSVKGRFTMSRDNAKNTVDLQMNSLKPEDTALYYCAGSSRI YIYSDSLSERSYDYWGQGTQVTVSS |
| LG2075D | 221 | EVQLVESGGGLVQAGGSLRLSCEASGRTFSNYAMGWFRQAPGKEREFVAVV TRWSGGRTVYADSVKGRFTISRDNAENTVYLQMNSLKPEDTAVYTCAADST NRNSGAWYYTWAYDHWGQGTQVTVSS |
| LG2075E | 222 | EVQLVESGGGSVQPGGSLRLSCAASGSIVGINAMGWYRQALGKQRELVATI GNGGNTNYADSAKGRFSISRHNAKNSVYLQMNSLKPEDTAVYFCNLKQPEN HAITNYWGQGTQVTVSS |
| LG2076A | 223 | EVQLVESGGGLVQPGGSLRLSCAASGSIFSINAMGWYRQAPGKQRELVAHI TSGGSTNYADSVKGRFTISRDNAKNTVYLQMNSLKPEDTAVYYCNHRGAGA HRVDDYWGQGTQVTVSS |
| LG2076B | 224 | EVQLVESGGGLVQAGGSLRLSCEASGRTYSRYGMGWFRQAPGKEREFVAAV SRLSGPRTVYADSVKGRFTISRDNAENTVYLQMNSLKPEDTAVYTCAAELT NRNSGAYYYAWAYDYWGQGTQVTVSS |
| LG2076C | 225 | EVQLVESGGGLVQPGGSLKLSCAASGGFFSIDAMGWYRQAPGKQRELVAAI TSGGNTNYADSVKGRFTISRDNAKNTVYLQMNSLKPEDTAVYYCNTEGREA RNHGLYEYHSWGQGTQVTVSS |
| LG2076D | 226 | EVQLVESGGGLVQPGGSLRLSCAASGSIFGLNAMGWYRQVPGKERELVVSI SSGGSTTYADSVKGRGRFTISRDDAKNTVYLQMNSLKPEDTGVYYCNARVP GAHYIMDYWGKGTLVTVSS |

TABLE A-1-continued

Preferred $V_{HH}$ sequences or NANOBODY® ($V_{HH}$ sequences)(also referred herein as a sequence with a particular name or SEQ ID NO: X, wherein X is a number referring to the relevant amino acid sequence):

| Name | SEQ ID NO: | Amino acid sequence |
|---|---|---|
| LG2076E | 227 | EVQLVESGGGLVQPGGSLRLSCAASGSIVGINAMGWYRQAPGKQRELVATIGNGGNTNYADSAKGRFSISRHNAKNSVYLQMNSLKPEDTAVYFCNLKQPENHAITNYWGQGTQVTVSS |
| LG2076F | 228 | EVQLVESGGGLVQAGGSLKLSCAVSARIFSTNSVDWYRQIPGKQRDWVATITPSPYTYYADSVKGRFTISRDDAKNTVYLHMNSLKPEDTAVYYCKTLDNWGQGTQVTVSS |
| LG2079A | 229 | EVQLVESGGGLVQAGGSLRLSCAASGRTFSSSFMAWFRQVLGSDREFVGGISPGGRFTYYADSRKGRFTISGDNANNTVYLQMHSVKPEDTATYYCAADTQFSGYVPKETNEYDYWGQGTQVTVSS |
| LG2079B | 230 | EVQLVESGGGLVQAGGSLRLSCAASGRTFSSSFMAWFRQVLGSDREFVGGISPGGRFTYYADSRKGRFTISGDNANNTVYLQMHSVKPEDTATYYCAADTQFSGYVPKETNEYDYWGQGTQVTVSS |
| LG2079C | 231 | EVQLVESGGGLVQAGGSLRLSCAASGRTGGTITMAWFRQAPGKEREFVAVISWGGITTSYADSVKGRFTISRDHAKNEQYLEMNSLKPEDTAVYFCTARAGSGLRTTINDYTYWGQGTQVTVSS |
| LG2079D | 232 | EVQLVESGAGLVQAGGSLRLSCTASGRTFSSYAMGWFRQTPGKEREFVASISWIGEFIYYADSVKGRFTISGENAKNTVYLQMNRLKPEDTAVYYCAAKTLVGDTTAFDRWGQGTQVTVSS |
| LG2079E | 233 | EVQLVKSGGGLVQAGGSLKLSCAASGRAFSSYTMGWFRQAPGKEREFVASISRDGGTPYYAYSVKGRFTISRDNAKNTVYLQMNSLGPEDTAIYTCAAKENGMFITATQEQSYDYWGQGTQVTVSS |
| LG2079F | 234 | EVQLVESGGGLVQPGGSLRLSCAASGFVFSHYAMSWVRQAPGKGLEWVSDITNGGLSTTYRDSVKGRFTISRDNAKNTLYLQMDSLKPEDTAVYYCSKDLYPFVSREYDYRGQGTQVTVSS |
| LG2079G | 235 | EVQLVESGGGLVQAGGSLRLSCAASERTVIAYTMGWFRRAPGKERDFVAAMNWNGGNTIYADSAKGRFTISRDNAKNTVYLQMNSLKAEDTAVYYCAARPRFWGSYEYDYWGQGTQVTVSS |
| LG2079H | 236 | EVQLVESGGGLVQAGGSLRLSCAASGRTFSSSFMAWFRQALGSDREFLGGISPGSRFTYYADSGKGRFTISRDNANNTVYLQMHSLKPEDTATYYCAADTEFSGYVQKESNDYDYWGQGIQVTVSS |
| LG213B7 | 237 | EVQLVESGGGLVQAGGSLRLSCTVSGDTFDNSAAGWYRATSETQRELVARIRSSGSTNYADSVKGRFTVSRDNAKNTVYLQMNSLKPEDTAVYYCNVVSYGEYFWGKGTLVTVSS |
| LG213D6 | 238 | EVQLVESGGGLVQPGGSLRLSCAASGFTFGDSDMSWVRQAPGEGPEWVAGINSGGGSTVYADSVKGRFTISRDNAKNMLYLQMNSLKPEDTAVYLCAQGLMAEVTAGYWGQGTQVTVSS |
| LG213D7 | 239 | EVQLVESGGGLVQAGGSLRLSCTVSGDTFDNSAAGWYRATSETQRELVARIRSSGSTNYADSVKGRFTVSRDNAKNTVYLQMNSLKPEDTAVYYCNVVSYGEYFWGKGTLVTVSS |
| LG213E6 | 240 | EVQLVESGGGLVQAGASLRLSCAASGSTLSRYGVGWFRQAPGKERELVASVDWSGSRTYYADSVKGRFTISRDNAKNTGYLQMNSLKPDDTAVYYCAADSSVVPGIEKYDDWGLGTQVTVSS |
| LG213H7 | 241 | EVQLVESGGGLVQAGGSLRLSCAASGRTLSSYRMGWFRQAPGKEREFISTISWNGRSTYYADSVKGRFIFSEDNAKNTVYLQMNSLKPEDTAVYYCAAALIGGYYSDVDAWSYWGPGTQVTVSS |
| LG214A8 | 242 | EVQLVKSGGGSVQAGGSLRLSCAASGGTFNPYVMAWFRQAPGNEREFVARIRWSGGDAYYDDSVKGRFAITRDAAKNTVHLQMNSLKPEDTAVYYCAAATYGYGSYTYGGSYDLWGQGTQVTVSS |
| LG214C10 | 243 | EVQLVESGGGLVQPGGSLRLSCAASGFIFGSYDMSWVRQAPGKGPEWVSGINSGGGSTGYADSVKGRFTISRDNAKNTLYLQMNSLKPEDTAVYYCSTNLYPTTDDVWGQGTQVTVSS |
| LG214D10 | 244 | EVQLVESGGGLVQAGGSLRLSCAASGGRTFSRVVAGWFRQAPGKEREFVAAISWDGVQTYYTDSVEGRFTVSRDSAKITVFLQMDNLKPEDTAVYYCAADKGVYTTVSRSMADYGAWGQGTQVTVSS |

TABLE A-1-continued

Preferred $V_{HH}$ sequences or NANOBODY® ($V_{HH}$ sequences)(also referred herein as a sequence with a particular name or SEQ ID NO: X, wherein X is a number referring to the relevant amino acid sequence):

| Name | SEQ ID NO: | Amino acid sequence |
|---|---|---|
| LG214E8 | 245 | EVQLVESGGGSVQAGGSLRLSCAASGGTFNPYVMAWFRQAPGNEREFVARIRWSGGDAYYDDSVKGRFAITRDAAKNTVHLQMNSLKPEDTAVYYCAAATYGYGSYTYGGSYDLWGQGTQVTVSS |
| LG214F8 | 246 | EVQLVESGGDLVQAGGSLRLSCVASGSTYSINAMGWYRQAPGKLRELVAAFRTGGSTDYADSVKGRFTISRDTAKNTVYLQMNSLKPEDTAVYYCNAEVIYYPYDYWGQGTQVTVSS |
| LG214H10 | 247 | EVQLVESGGGSVQAGGSLRLSCAASGGTFNPYVMAWFRQAPGNEREFVARIRWSGGDAYYDDSVKGRFAITRDAAKNTVHLQMNSLKPEDTAVYYCAAATYGYGSYTYGGSYDLWGQGTQVTVSS |
| RSVPMP5C1 | 248 | EVQLVESGGGLAQAGGSLRLSCAASGRTLTSYIMGWFRQAPGKERMFVAAISGTGTIKYYGDLVKGRFTISRDNAKNTVYLQIDSLQPEDTAVYYCAARQDYGLGYRDLHEYDYWGQGTQVTVSS |
| RSVPMP8A1 | 249 | EVQLVESGGGLVQPGGSLRVSCAASGFTFNDYIMGWFRQAPGKERMFIAAISGTGTIKYYGDLVRGRFTISRDNAKNTVYLRIDSLNPEDTAVYYCAARQDYGLGYRESHEYDYWGQGTQVTVSS |
| RSVPMP8G1 | 250 | EVQLVESGGGLVQPGGSLRVSCAASGFTFNSYIMGWFRQAPGKERMFIAAISGTGTIKYYGDLVGGRFTISRDNAKNTVYLRIDSLNPEDTAVYYCAARQDYGLGYRESHEYDYWGQGTQVTVSS |
| RSVPMP25B3 | 251 | EVQLVESGGGLVQPGGSLRLSCAASGFTFNSYIMGWFRQAPGKERMFIAAISGTGTIKYYGDLVGGRFTISRDNAKNTVYLRIDSLNPEDTAVYYCAARQDYGLGYRESHEYDYWGQGTQVTVSS |
| RSVPMP8C8 | 252 | EVQLVESGGGLVQAGGSLRLSCVASGGTFSTYGMGWFRQAAGKEREFAVAISRSGANIYYGTSTQGRFTISRDNAKNTLYLQMNSLEPEDTAVYYCAASKEWDISASGDDYDYWGQGTQVTVSS |
| RSVPMP5A6 | 253 | EVQLVESGGGLVQPGGSLRLSCTAYGFIFDRSRMFWARQAPGKGFEWLSSILTAGDTWYSDSVKGRFTISRDNAKNTLYLQMNDLKSEDTAVYYCSKDGIYSSKGQGTQVTVSS |
| RSVPMP8E11 | 254 | EVQLVESGGGLVQPGGSLRLSCTAYGFIFDRSRMFWARQAPGKGFEWLSSILTAGDTWYSDSVKGRFTISRDNAKNTLYLQMNDLKSEDTAVYYCSKDGIYSSKGQGTQVTVSS |
| RSVPMP8F11 | 255 | EVQLVESGGGLVQPGGSLRLSCTAYGFIFDRSRMFWARQAPGKGFEWLSSILTAGDTWYSDSVKGRFTISRDNAKNTLYLQMNDLKSEDTAVYYCSKDGIHSSKGQGTQVTVSS |
| RSVPMP13F11 | 256 | EVQLVESGGDLVQPGGSLRLSCTAYGFIFDQARMFWARQAPGKGFEWLSSILTAGDTWYSDSVKGRFTISRDNAKNTLYLQMNDLKSEDTAVYYCSKDGIYSSKGQGTQVTVSS |
| RSVPMP15B8 | 257 | EVQLVESGGGLVQPGGSLRLSCTAYGFIFDQSRMFWARQAPGKGFEWLSSILTAGDTWYSDSVKGRFTISRDNAKNTLYLQMNDLKSEDTAVYYCSKDGIYSSKGQGTQVTVSS |
| RSVPMP15G11 | 258 | EVQLVESGGGLVQPGGSLRLSCTAYGFIFDQSRMFWARQAPGKGFEWLSSILTAGDTWHSDSVKGRFTISRDNAKNTLYLQMNDLKSEDTAVYYCSKDGIYSSKGQGTQVTVSS |
| RSVPMP17C10 | 259 | EVQMVESGGDLVQPGGSLRLSCTAYGFIFDQARMFWARQAPGKGFEWLSSILTAGDTWYSDSVKGRFTISRDNAKNTLYLQMNDLKSEDTAVYYCSKDGIYSSKGQGTQVTVSS |
| RSVPMP21E7 | 260 | EVQLVESGGDLVQPGGSLRLSCTAYGFIFDQARMFWARQAPGKGFEWLSSILTAGDTWYSDSVKGRFIISRDNAKNTLYLQMNDLKSEDTAVYYCSKDGIYSSKGQGTQVTVSS |
| RSVPMP21F8 | 261 | EVQLVESGGGLVQPGGSLRLSCTAYGFVFDQSRMFWARQAPGKGFEWLSSILTAGDTWYSDSVKGRFTISRDNAKNTLYLQMNDLKSEDTAVYYCSKDGIHSSKGRGTQVTVSS |
| RSVPMP5A2 | 262 | EVQLVESGGGLVQPGGSLRLSCEASGFTWDYYVIGWFRQAPGKEREGLSCISSDGSTTYADSVKGRFTISRDNAKNTVYLQMNSLKPEDTAVYYCATDPALGCYSGTYYPRYDYWGQGTQVTVSS |

TABLE A-1-continued

Preferred $V_{HH}$ sequences or NANOBODY® ($V_{HH}$ sequences)(also referred herein as a sequence with a particular name or SEQ ID NO: X, wherein X is a number referring to the relevant amino acid sequence):

| Name | SEQ ID NO: | Amino acid sequence |
|---|---|---|
| RSVPMP5B2 | 263 | EVQLVESGGGLVQPGGSLRLSCAASGLTLDYYALGWFRQAPGKEREGVSCISSVDHSTTYADSVKGRFTISWDNAKNTVYLQMNSLKPEDTAVYYCAADPALGCYSGSYYPRYDYWGQGTQVTVSS |
| RSVPMP5C3 | 264 | EVQPVESGGGLVQPGGSLRLSCEASGFTWDYYVIGWFRQAPGKEREGLSCISSSDGSTTYADSVKGRFTISRDNAKNTVYLQMNSLKPEDTAVYYCAVDPALGCYSGSYYPRYDYWGQGTQVTVSS |
| RSVPMP5D2 | 265 | EVQLVESGGGLVQPGGSLRLSCEASGFTWDYYVIGWFRQAPGKEREGLSCISSSDGSTTYADSVKGRFTISRDNAKNTVYLQMNSLKPEDTAVYYCAVDPALGCYSGSYYPRYDYWGQGTQVTVSS |
| RSVPMP5E2 | 266 | EVQLVESGGGLVQPGGSLRLSCAASGLTLDYYAIGWFRQAPGKEREGVSCISSSDHSTTYADSVKGRFTISWDNAKNTVYLQMNSLKPEDTAVYYCAADPALGCYSGSYYPRYDYYGQGTQVTVSS |
| RSVPMP5F3 | 267 | EVQLVESGGGLVQPGGSLRLSCAASGLTLDYYALGWFRQAPGKEREGVSCISSSDHSTTYTDSVKGRFTISWDNAKNTLYLQMNSLKPEDTAVYYCAADPALGCYSGSYYPRYDYWGQGTQVTVSS |
| RSVPMP5G3 | 268 | EVQLVESGGGLVQPGGSLRLSCEASGFTWDYYVIGWFRQAPGKEREGLSCISSDGSTTYADSVKGRFTISRDNAKNTVYLQMNSLKPEDTAVYYCATDPALGCYSGSYYPRYDYWGQGTQVTVSS |
| RSVPMP5H2 | 269 | EVQLVESGGGLVQPGGSLRLSCAASGLTLDYYAIGWFRQAPGKEREGVSCISSVDHSTTYADSVKGRFTISWDSAKNTVYLQMNDLKPEDTAVYYCAADPALGCYSGSYYPRYDYWGQGTQVTVSS |
| RSVPMP5H3 | 270 | EVQLVESGGGLVQPGGSLRLSCAASGFTSDYYAIGWFRQAPGKEREGVSCISSSDGSTTYADLVKGRFTISRDNAKNTVYLQMNSLQPEDTAVYYCAADPALGCYSGSYYPRYDYWGQGTQVTVSS |
| RSVPMP8C1 | 271 | EVQLVESGGGLVQPGGSLRLSCAASGFTWDYYVIGWFRQAPGKEREGVSCISSDGTTTYPDSVKGRFTISRDNAKNTVYLQMNSLKPEDTAVYYCAADPALGCYSGSYYPRYDYWGQGTQVTVSS |
| RSVPMP8F2 | 272 | EVQLVESGGGLVQPGGSLRLSCAASGFTWDYYAIGWFRQAPGKEREGVSCISSSDGSTTYADSVKGRFTISRDNAKNTVYLQMNSLTPEDTAVYYCAVDPALGCYSGSYYPRYDYWGQGTQVTVSS |
| RSVPMP8G4 | 273 | EVQLEESGGGLVQPGGSLRLSCEASGFTWDYYVIGWFRQAPGKEREGLSCISSDGLTTYADSVKGRFTISRDNAKNTVYLQMNGLKPEDTAVYYCATDPALGCYSGSYYPRYDYWGQGTQVTVSS |
| RSVPMP13A1 | 274 | EVQLVESGGGLVQPGGSLRLSCAASGLTLDYYALGWFRQAPGKEREGVSCISSADHSTTYADSVKGRFTISWDNAKNTVYLQMNSLKPEDTAVYYCAADPALGCYSGNYYPRYDYWGQGTQVTVSS |
| RSVPMP13A4 | 275 | EVQLVESGGGLVQPGGSLRLSCAASGLTLDYYALGWFRQAPGKEREGVSCISSADHSTTYADSVKGRFTISWDNAKNTVYLQMNSLKPEDTAVYYCAADPALGCYSGSYYPRYDYWGQGTQVTVSS |
| RSVPMP13B1 | 276 | EVQLVESGGGLVQPGGSLRLSCAASGFTWDYYVIGWFRQAPGKEREGVSCISSSDGSTTYADFVKGRFTISRDNAKNTVYLQMNSLTPEDTAVYYCAADPALGCYSGNYYPRYDYWGQGTQVTVSS |
| RSVPMP13B2 | 277 | EVQLVESGGGLVQPGGSVRLSCAASGFTWDYYVIGWFRQAPGKEREGLSCISSDGSTTYADSVKGRFTISRDNAKNTVYLQMNSLKPEDTAVYYCATDPALGCYSGSYYPRYDYWGQGTQVTVSS |
| RSVPMP13C1 | 278 | EVQLVESGGGLVQPGGSLRLSCEASGFTWDYYVIGWFRQAPGKEREGLSCISSDGSTTYADSVKGRFTISRDNAKNTVYLQMNSLEPEDTAVYYCATDPALGCYSGSYYPRYDYWGQGTQVTVSS |
| RSVPMP13C3 | 279 | EVQLVESGGGLVQPGGSLRLSCAASGLTLDYYALGWFRQAPGKEREGVSCISSVDHSTTYADSVKGRFTISWDNAKNMVYLQMNSLKPEDTAVYYCAADPALGCYSGNYYPRYDYWGQGTQVTVSS |
| RSVPMP13D6 | 280 | EVQLVESGGGLVQPGGSLRLSCAASGLTLDYYALGWFRQAPGKEREGVSCISSSDHSTTYADSVKGRFTISWDNAKNTVYLQMNSLKPEDTAVYYCAADPALGCYSGSYYPRYDYWGQGTQVTVSS |

TABLE A-1-continued

Preferred $V_{HH}$ sequences or NANOBODY® ($V_{HH}$ sequences)(also referred herein as a sequence with a particular name or SEQ ID NO: X, wherein X is a number referring to the relevant amino acid sequence):

| Name | SEQ ID NO: | Amino acid sequence |
|---|---|---|
| RSVPMP13E2 | 281 | EVQLVESGGGLVQPGGSLRLSCAASGLTLDYYAIGWFRQAPGKEREGVSCI SSTDHSTTYADSVKGRFTISWDNAKKMVYLQMNKLKPEDTAVYYCAADPAL GCYSGSYYPRYDYWGQGTQVTVSS |
| RSVPMP13E3 | 282 | EVQLVESGGGLVQPGGSLRLSCAASGLTLDYYALGWFRQAPGKEREGVSCI SSSDHTTTYADSVKGRFTISWDNAKNTLYLQMNSLKPEDTAVYYCAADPAL GCYSGSYYPRYDFWGQGTQVTVSS |
| RSVPMP15A5 | 283 | EVQLVESGGGLVQPGGSLRLSCAASGFTWDYYAIGWFRQAPGKEREGVSCI SSSDGSTTYADSVKGRFTISRDNTKNTVYLQMNSLTPEDTAIYYCAVDPAL GCYSGNYYPRYDYWGQGTQVTVSS |
| RSVPMP15A6 | 284 | EVQLVESGGGLVQPGGSLRLSCAASGLTLDYYALGWFRQAPGKEREGVACI DSSDHSTTYADSVKGRFTISWDNAKNTVYLQMSSLKPEDTAVYHCAADPAL GCYSGSYYPRYDYWGQGTQVTVSS |
| RSVPMP15B2 | 285 | EVQLVESGGGLVQPGGSLRLSCEASGFTWDYYVIGWFRQAPGKEREGLSCI SSDGSTTYADSVKGRFTISRDNAKNMVYLQMNSLKPEDTAVYYCATDPALG CYSGSYYPRYDYWGQGTQVTVSS |
| RSVPMP15B3 | 286 | EVQLVESGGGLVQPGGSLRLSCAASGLTLDYYALGWFRQAPGKEREGVSCI SSSDHSTTYTDSVKGRFTISWDNAKNTLYLQMNSLKPGDTAVYYCAADPAL GCYSGSYYPRYDYWGQGTQVTVSS |
| RSVPMP15E5 | 287 | EVQLVESGGGLVQPGGSLRLSCAASGFTWDYYVIGWFRQAPGKEREGVSCI SSSDGSTTYADFVKGRFTISRDNAKNTVYLQMNNLTPEDTAVYYCATDPAL GCYSGNYYPRYDYWGQGTQVTVSS |
| RSVPMP17C2 | 288 | EVQLVESGGGLVQPGGSLRLSCAASGFTWDYYVIGWFRQAPGKEREGVSCI SSSDGSTTYADFVKGRFTISRDNARNTVYLQMNNLTPEDTAVYYCATDPAL GCYSGNYYPRYDYWGQGTQVTVSS |
| RSVPMP17D4 | 289 | EVQLVESGGGLVQPGGSLRLSCAASGLTLDYYALGWFRQAPGKEREGVSCI SSVDHSTTYADSVKGRFTISWDNAKNIVYLQMNSLKPEDTAVYYCAADPAL GCYSGSYYPRYDYWGQGTQVTVSS |
| RSVPMP17G4 | 290 | EVQLVESGGGLVQPGGSLRLSCAASGLTLDYYAIGWFRQAPGKEREGVSCI SSVDHSTTYADPVKGRFTISWDSAKNTVYLQMNDLKPEDTAVYYCAADPAL GCYSGSYYPRYDYWGQGTQVTVSS |
| RSVPMP19B2 | 291 | EVQLVESGGGLVQPGGSLRLSCAASGLTLDYYAIGWFRQAPGKEREGVSCI SSSDHSTTYADSVKGRFTISWDNAKKVVYLQMNSLKPEDTAVYYCAADPAL GCYSGSYYPRYDYWGQGTQVTVSS |
| RSVPMP25A4 | 292 | EVQLVESGGGLVQPGGSLRLSCAASGLTLDYYALGWFRQAPGKEREGVSCI SSVDHSTTYADSVKGRFTISWDNAKNMVYLQMNSLKPEDTAVYYCAADPAL GCYSGSYYPRYDYWGQGTQVTVSS |
| RSVPMP25A9 | 293 | EVQLVESGGGLVQPGGSLRLSCEASGFTWDYYVIGWFRQAPGKEREGLSCI SSDGLTTYADSVKGRFTISRDNAKNTVYLQMNGLKPEDTAVYYCATDPALG CYSGSYYPRYDYWGQGTQVTVSS |
| RSVPMP25B5 | 294 | EVQLVESGGGLVQPGGSLRLSCAASGLTLDYYALGWFRQAPGKEREGVSCI SSSDHSTTYADSVKGRFTISWDNAKNTLYLQMNSLKPEDTAVYYCAADPAL GCYSGSYYPRYDYWGQGTQVTVSS |
| RSVPMP25G2 | 295 | EVQLVESGGGLVQPGGSLRLSCAASGLTLDYYALGWFRQAPGKEREGVSCI SSVDHSTTYADSVKGQFTISWDNAKNMVYLQMNSLKPEDTAVYYCAADPAL GCYSGSYYPRYDYWGQGTQVTVSS |
| RSVPMP25H5 | 296 | EVQLVESGGGLVQPGGSLRLSCVASGLTLDYYALGWFRQAPGKEREGVSCI SSSDHSTTYADSVKGRFTISWDNAKNTVYLQMNSLKPEDTAVYYCAADPAL GCYSGSYYPRYDYWGQGTQVTVSS |
| RSVPMP25E11 | 297 | EVQLVESGGGLVQPGGSLRLSCAASGFTWDYYAIGWFRQAPGKEREGVSCI SSSDGSTTYADSVKGRFTISRDNTKNTVYLQMNSLTPEDTAVYYCAVDPAL GCYSGNYYPRYDYWGQGTQVTVSS |
| RSVPMP8G3 | 298 | EVQLVESGGGLVQPGGSLRLSCAASGLTLDYYALGWFRQAPGKEREGVSCI SSSDHTTTYADSVKGRFTISWDNAKNTLYLQMNSLKPEDTAVYYCAADPAL GCYSGSYYPRYDFWGQGTQVTVSS |

TABLE A-1-continued

Preferred $V_{HH}$ sequences or NANOBODY® ($V_{HH}$ sequences)(also referred herein as a sequence with a particular name or SEQ ID NO: X, wherein X is a number referring to the relevant amino acid sequence):

| Name | SEQ ID NO: | Amino acid sequence |
|---|---|---|
| RSVPMP13B5 | 299 | EVQLVESGGGLVQPGGSLRLSCAASGLTLDYYALGWFRQAPGKGREGVSCI SSSDHTTTYADSVKGRFTISWDNAKNTLYLQMNSLKPEDTAVYYCAADPAL GCYSGNYYPRYDFWGQGTQVTVSS |
| RSVPMP15F2 | 300 | EVQLVESGGGLVQPGGSLRLSCAASGLTLDYYALGWFRQAPGKEREGVSCI SSSDHTTTYADSVKGRFTISWDNAKNTLYLQMNSLKPEDTAVYYCAADPAL GCYSGNYYPRYDFWGQGTQVTVSS |
| RSVPMP19E2 | 301 | EVQLVESGGGLVQPGGSLRLSCAASGLTLDYYALGWFRQAPGKEREGVSCI SSSDHTTTYTDSVKGRFTISWDNAKNTLYLQMNSLKPEDTAVYYCAADPAL GCYSGSYYPRYDFWGQGTQVTVSS |
| RSVPMP25D1 | 302 | EVQLVESGGGLVQPGGSLRLSCAASGLTLDYYALGWFRQAPGKEREGVSCI SSSDHTTTYADSVKGRFTISWDNAKNTLYLQMTSLKPEDTAVYYCAADPAL GCYSGSYYPRYDFWGQGTQVTVSS |
| RSVPMP5A1 | 303 | EVQLMESGGGLVQPGGSLRLSCATSGFTLDYYVIGWFRQAPGKEREGVSCM SSSGDITTYAPSVKGRFTISRDNAKNMVYLQMTSLKPEDTAVYYCAADFAL GCYSGSYVPRYDYWGQGTQVTVSS |
| RSVPMP5G2 | 304 | EVQLVESGGGLVQPGGSLRLSCATSGFTLDYYVIGWFRQAPGKEREGVSCM SSSGDSTTYADSVKGRFTISRDNAKNMVYLQMTSLKPEDTAVYYCAADFAL GCYSGSYYPRYDYWGQGTQVTVSS |
| RSVPMP5H1 | 305 | EVQLVESRGGLVQPGGSLRLSCATSGFTLDYYVIGWFRQAPGKEREGVSCM SSSGDSTTYADSVKGRFTISRDTAKNMVYLQMTSLKPEDTAVYYCAADFAL GCYSGSYYPRYDYWGQGTQVTVSS |
| RSVPMP6B1 | 306 | EVQLVESGGGLVRPGGSLRLSCATSGFTEDYYVIGWFRQAPGKEREGVSCM SSSGDSTTYADSVKGRFTISRDNAKNMVYLQMTSLKPEDTAVYYCAADFAL GCYSGSYYPRYDYWGQGTQVTVSS |
| RSVPMP8H2 | 307 | EVQLVESGGGLVRPGGSLRLSCATSGFTEDYYVIGWFRQAPGKEREGVSCM SSSGDSTTYADSVKGRFTISRDNAKNMVYLQMTSLKPEDTAVYYCAADFAL GCYSGSYYPRYDYWGQGTQVTVSS |
| RSVPMP8H3 | 308 | EVQLVESGGGLVQPGGSLRLSCATSGFTEDYYVIGWFRQAPGKEREGVSCM SSSGDSTTYADSVKGRFTISRDNAKNMVYLQMTSLKPEDTAVYYCAADFAL GCYSGSYYPRYDYWGQGTQVTVSS |
| RSVPMP13A3 | 309 | EVQLVESGGGLVQPGGSLRLSCATSGFTLDYYVIGWFRQAPGKEREGVSCM SSSGDSTTYADSVKGRFTISRDTAKNMVYLQMTSLKPEDTAVYYCAADFAL GCYSGSYYPRYDYWGQGTQVTVSS |
| RSVPMP13C5 | 310 | EVQLVESGGGLVQPGGSLRLSCATSGLTLDYYVIGWFRQVPGKEREGVSCM SSSGDSTTYADSVKGRFTISRDNAKNMVYLQMTSLMPEDTAVYYCAADFAL GCYSGSYYPRYDYWGQGTQVTVSS |
| RSVPMP13H1 | 311 | EVQLVESGGGLVQPGGSLRLSCATSGFTMDYYVIGWFRQAPGKEREGVSCM SSSGDSTTYAPSVKGRFTISRDNAKNMVYLQMTSLKPEDTAVYYCAADFAL GCYSGSYYPRYDYWGQGTQVTVSS |
| RSVPMP13H2 | 312 | EVQLVESGGGLVQPGGSLTLSCATSGLTLDYYVIGWFRQAPGKEREGVSCM SSSGDSTTYADSVKGRFTISRDNAKNMVYLQMTSLKPEDTAIYYCAADFAL GCYSGSYYPRYDYWGQGTQVTVSS |
| RSVPMP15E6 | 313 | EVQLVESGGGLVQPGGSLRLSCATSGFTEDYYVIGWFRQAPGKEREGVSCM SSSGDSTTYADSVQGRFTISRDNAKNMVYLQMTSLKPEDTAVYYCAADFAL GCYSGSYYPRYDYWGQGTQVTVSS |
| RSVPMP17A3 | 314 | EVQLVESGGGLVQPGGSLRLSCATSGFTLDYYVIGWFRQAPGKEREGVSCM SSSGDITTYAPSVKGRFTISRDNAKNMVYLQMTSLKPEDTAVYYCAADFAL GCYSGSYVPRYDYWGQGTQVTVSS |
| RSVPMP25G8 | 315 | EVQLVESGGGLVQPGGSLRLSCATSGFTLDYYVIGWFRQAPGKEREGVSCM SSSGDITTYAPSVKGRFTISRDNAKNMVYLQMTSLKPEDTAVYYCAADFPL GCYSGSYVPRYDYWGQGTQVTVSS |
| RSVPMP6D1 | 316 | EVQLVESGGGLVQAGGSLRLSCAASGFTFDDYAIGWFRQAPGKEREAVSCI SSSDGTTYYADSVKGRFTISSDNAKNTVYLTMNNLKPEDTAVYYCAADRLS TVVGCLYYGGSYYPRTTIDYWGKGTLVTVSS |

TABLE A-1-continued

Preferred $V_{HH}$ sequences or NANOBODY® ($V_{HH}$ sequences)(also referred herein as a sequence with a particular name or SEQ ID NO: X, wherein X is a number referring to the relevant amino acid sequence):

| Name | SEQ ID NO: | Amino acid sequence |
|---|---|---|
| RSVPMP8D5 | 317 | EVQLVESGGGLVQAGGSLRLSCAASGFTFDDYAIGWFRQAPGKEREAVSCI SSSDGSTYYTDSVKGRFTISSDNAKNTVYLTMNSLKPEDTAVYYCAADLLS TVVGCLYYRGSYYPRTTADYWGKGTLVTVSS |
| RSVPMP13B4 | 318 | EVQLVESGGGLVQAGGSLRLSCAASGFTFDDYAIGWFRQAPGKEREAVSCI SSSDGSTYYADSVKGRFTISSDNAKNMVYLQMNSLKPEDTAVYYCAADLLR TAVGCLDYRGTYYPRTTMDYRGKGTLVTVSS |
| RSVPMP13B6 | 319 | EVQLVESGGGLVQAGGSLRLSCAASGFTFDDYAIGWFRQAPGKEREAVSCI SSSDSSTYYTDSVKGRFTISSDNAKNTVYLTMNSLKPEDTAVYYCAADLLS TVVGCLYYRGSYYPRTTADYWGKGTLVTVSS |
| RSVPMP13E6 | 320 | EVQLVESGGGLVQAGGSLRLSCAASGFTFDDYAIGWFRQAPGKEREAVSCI SSSDGVTYYSDSVKGRFTISSDNAKNTVYLQMNSLKPEDTAVYYCAADLLR TAVGCLYYRGTYYPRTTMDYRGKGTLVTVSS |
| RSVPMP13F4 | 321 | EVQLVESGGGLVQAGGSLRLSCAASGFTFDDYAIGWFRQAPGKEREAVSCI SSSDGSTYYTDSVKGRFTISSDNAKNTVYLTMNSLKPEDTAVYYCAADQLS TVVGCFYYRGSYYPRTTADYWGKGTLVTVSS |
| RSVPMP15H3 | 322 | EVQLVESGGGLVQAGGSLRLSCAASGLTFDDYAIGWFRQAPGKEREAVSCI SSSDGSTYYADSVKGRFTISRDNAKNTVYLQMNSLKPEDTAVYYCAADLLA TAVGCLYYRGTYYPRTTMDYWGKGTLVTVSS |
| RSVPMP17E5 | 323 | EVQLVESGGGLVQAGGSLRLSCAASGFTFDDYAIGWFRQAPGKEREAVSCI SSSDGTTYYADSVKGRFTISSDNAKNTVYLAMNNLKPGDTAVYYCAADLLS TVVGCLYYGGSYYPRTTIDYWGKGTLVTVSS |
| RSVPMP19D3 | 324 | EVQLVESGGGLVQAGGSLRLSCAASGFTFDDYAIGWFRQAPGKEREGVSCI DSSDGSTYYADSVKGRFTISSDNAKNTVYLQMNSLKPEDTAVYYCAADLLR TVVGCLYYGGRYSPRTTTDYWGKGTLVTVSS |
| RSVPMP19F3 | 325 | EVQLVESGGGLVQAGGSLRLSCAASGFTFDDYAIGWFRQAPGKEREAVSCI SSSDGTTYYADSVKGRFTISSDNAKNTVYLTMNNLKPEDTAVYYCAADLLS TVVGCLYYGGSYYPRTTIDYWGKGTLVTVSS |
| RSVPMP25C4 | 326 | EVQLVESGGGLVQAGGSLRLSCAASGFTFDDYAIGWFRQAPGKEREAVSCI SSSDGTYYADSVKGRFTISSDNAKNTVYLQMNSLKPEDTAVYYCAADLLRT AVGCLHYRGSYYPRTTIDYWGKGTLVTVSS |
| RSVPMP25E3 | 327 | EVQLVESGGGKVQPGGSLRLSCAASGFTFDDYAIGWFRQAPGKEREGVSCI DSSDGSTYYADSVKGRFTISKDNAKNTVYLQMNSLKPEDTAVYYCAADLLR TVVGCLYYGGSYSPRTTMDYWGKGTLVTVSS |
| RSVPMP5G4 | 328 | EVQLVESGGGLVQAGGSLRLSCAASGRTFSSYAMGWFRQAPGKEREFVGAI SGSGSNIYYANSMPGRITIFRDNAKNTAYLQMNSLNPEDTAVYYCAAAPTL VEITTTPTYWGQGTQVTVSS |
| RSVPMP6G5 | 329 | EVQLVQSGGGLVQAGGSLRLSCAASGRTFSSYAMGWFRQAPGKEREFVGAI SGSGSNIYYANAMPGRITIFRDNAKNTVYLQMNSLNPEDTAVYYCAAAPTL VEITPTPTYWGQGTQVTVSS |
| RSVPMP8E6 | 330 | EVQLVESGGGLVQAGGSLRLSCAASGRTFSSYAMGWFRQAPGKEREFVGAI SGSGSNIYYADSMPGRITIFRDNAKNTVYLQMNSLNPEDTAVYYCAAAPTL VEITPTPTYWGQGTQVTVSS |
| RSVPMP13A10 | 331 | EVQLVESGGGLVQAGGSLRLSCAASGRTFSSYAMGWFRQAPGKEREFVGAI SESGSNIYYANAMPGRITIFRDNAKNTAYLQMNSLNPEDTAVYYCAAAPTL VEITTTPTYWGQGTQVTVSS |
| RSVPMP21H10 | 332 | EVQLVESGGGLVQAGGSLRLSCAASGRTFSSYAMGWFRQAPGKEREFVGAI SGSGSNIYYANSMPGRITIFRDNAKNTVYLQMNSLNPEDTAVYYCAAAPTL VEITPTPTYWGRGTRVTVSS |
| RSVPMP5A8 | 333 | EVQLVESGGGLVQAGGSLRLSCADHGRTLAYYTAGWFRQAPGKEREFVASI SRSSGSTRYADSVRGRFTISRDNAKNTVYLQMNSLKPEDTAAYYCATTDDY INTTPALYRNWGQGTQVTVSS |
| RSVPMP5A10 | 334 | EVQLVESGGGLVQAGDSLRLSCTASERTFRNDAGGWFRQAPGKEREFVAAI TSGGSTDYANSVKGRFTISRDNAKNTVYLQMNSLRPEDTAVYYCAADSNVN TVKLGWGRYWGQGTQVTVSS |

TABLE A-1-continued

Preferred $V_{HH}$ sequences or NANOBODY® ($V_{HH}$ sequences)(also referred herein as a sequence with a particular name or SEQ ID NO: X, wherein X is a number referring to the relevant amino acid sequence):

| Name | SEQ ID NO: | Amino acid sequence |
|---|---|---|
| RSVPMP14A6 | 335 | EVQLVESGGGLVQAGDSLRLSCTASERTFGNDAGGWFRQAPGKERDFVAAI TSGGSTDYANSVKGRFTISRDNAKNTVYLQMNSLRPEDTAVYYCAADSSVN TVKLGWGRYWGQGTQVTVSS |
| RSVPMP16A6 | 336 | EVQLVESGGGLVQAGDSLRLSCTASERTFGNDAGGWFRQAPGKERDFVAAI TSGGSTDYANSVKGRFTISRDNAKNTVYLQMNSLRPEDTAVYYCAADSNVN TVKLGWGRYWGQGTQVTVSS |
| RSVPMP22D6 | 337 | EVQLVESGGGLVHPGGSLRLSCAASERTFGNDAGGWFRQAPGKERDFVAAI TSGGSTDYANSVKGRFTISRDNAKNTVYLQMNSLRPEDTAVYYCAADSNVN TVKLGWGRYWGQGTQVTVSS |
| RSVPMP8E2 | 338 | EVQLVESGGGLVQPGGSLRLSCAASGSIWSITSMGWYRQAAGKQRELVAKI ISGGSTNYADSVKGRFTISRDNAKNTVYLQMNSLKPEDTAVYYCNADVRVA EKHTAYEANYWGQGTQVTVSS |
| RSVPMP8C6 | 339 | EVQLVESGGGLVQPGGSLSVSCAASGTIFAINAMGWYRQVPGKERELVAVM RNPGGTNYADSVKGRFTISRDNAKNTVYLQMNSLKPEDTAVYYCYLKMYGG NWYTYWGQGTQVTVSS |
| RSVPMP5C6 | 340 | EVQLVESGGGLVQAGASLRLSCAASGLAFSRYAMGWFRQAPGKERESVAAI SSSGDNIYYADSVKGQFTMSRDNAKSSVYLQMINLKPEDTAVYYCAAATSP LFVASDYFDASRYDYWGQGTQVTVSS |
| RSVPMP6D4 | 341 | EVQLVESGGGLVHAGASLRLSCVASGLAFSRYAMGWFRQAPGKERESVAAI SSSGDNIYYSRSVKGILSISRDNAKSAVYLQMNNLKPEDTAVYYCAAAAST LFIASDYFEASRYDYWGQGTQVTVSS |
| RSVPMP8B10 | 342 | EVQLVESGGGLVQAGASLRLSCAASGLAFSRYAMGWFRQAPGKERESVAAI SSSGDNIYYADSVKGQFTMSRDNAKSSVYLQMINLKPEDTAVYYCAATSPL FVASDYFEASRYGYWGQGTQVTVSS |
| RSVPMP8E10 | 343 | EVQLVESGGGLVQAGASLRLSCAASGLAFSRYAMGWFRQAPGKERESVAAI SSSGDNIYYPDSVKGQFTMSRDNAKSSVYLQMINLKPEDTAVYYCAAASPL FVASDYFEASRYGYWGQGTQVTVSS |
| RSVPMP15A7 | 344 | EVQLVESGGGLVHAGASLRLSCVASGLAFSRYAMGWFRQAPGKERESVAAI SSSGDNIYYSRSVKGILSISRDNAKSAVYLQMNNLKPEDTAVYYCAAAAST LFVASDYFEASRYDYWGQGTQVTVSS |
| RSVPMP15E10 | 345 | EVQLVESGGGLVQAGASLRLSCAASGLAFSRYAMGWFRQAPGKERESVAAI SSSGDNIYYADSVKGQFTMSRDNAKSSVYLQMINLEPEDTAVYYCAATSPL FVASDYFEASRYGYWGQGTQVTVSS |
| RSVPMP13C7 | 346 | EVQLVESGGGLVQAGGSLRLSCAASVGTFSNYDIGWFRQAPGKGREFVARI SSAGSNLYYGSSMPGRITISRDNAKNTVYLQMNSLKPEDTAIYYCAADNTA YGSFKADDYDYWGQGTQVTVSS |
| RSVPMP15A9 | 347 | EVQLVESGGGLVQPGGSLRLSCAASAGTFSNYDIGWFRQAPGKGREFVARI SSGGSNIYYGNSMPGRITISRDNAKNTVYLQMNSLTPEDTAIYYCAADSTA YGSFKADDYDYWGQGTQVTVSS |
| RSVPMP15F11 | 348 | EVQLVESGGGLVQPGGSLRLSCAASAGTLSNYDIGWFRQAPGKGREFVARI SSAGSNLYYGTSMPGRITISRDNAKNTVYLQMNSLKPEDTAIYYCAADSTA YGSFKADDYDYWGQGTQVTVSS |
| RSVPMP15A1 | 349 | EVQLVESGGGLVQPGGSLRLSCAASGFTLDYYAIGWFRQAPGKEREGVSCI SSWDGSTYYADSVKGRFTISRDNAKNTVYLQMNSLKPEDTAVYYCATDLTD SLCSYYDYMRPENDYWGQGTQVTVSS |
| RSVPMP6H2 | 350 | EVQLVESGGGLVQPGESLRLSCAASGFTLAYYAIGWFRQAPGKEREGVSCI SSWDGSTYYADSVKGRFTISRDNAKNTVYLQMNSLKPEDTAVYYCATDLTD SLCSYYHYMRPENDYWGQGTQVTVSS |
| RSVPMP17A9 | 351 | EVQLVESGGGLVQAGGSLRLSCAASGRTFSRYIMGWFRQAPGKEREFVGAI SRSGDITSFADFVKGRFTMSRDNAKNTLYLQMNSLEPEDTAVYSCAANSDT YYIYSDIVVPERYDYWGQGTQVTVSS |
| RSVPMP7G1 | 352 | EVQLVESGGGLVQAGDSLRLSCAASGRSFSSRAMGWFRQAPGKEREFVAAI NWIGNIPYYANSVKGRFTISRDNAKNTVYLQMNSLKPDDTAVYYCATGSEP YYTNTYDYWGQGTQVTVSS |

TABLE A-1-continued

Preferred $V_{HH}$ sequences or NANOBODY® ($V_{HH}$ sequences)(also referred herein as a sequence with a particular name or SEQ ID NO: X, wherein X is a number referring to the relevant amino acid sequence):

| Name | SEQ ID NO: | Amino acid sequence |
|---|---|---|
| RSVPMP5A9 | 353 | EVQLVESGGGLVQAGGSLRLSCGSSGRTFSRYAMGWFRQAPGKEREFVAAI SWSGGSTYYADSVKGRFTISRDNAKNTVYLQMNSLKPEDTAVYYCAADISS GNSGSYIYTWAYDYWGQGTQVTVSS |
| RSVPMP7B2 | 354 | EVQLVESGGGLVQAGDSLRLSCAASGRTFSSYAMGWFRQAPGKEREFVAAI SWSDGSTYYADSVKGRFTISRDNAKNTVYLQMNSLKPEDTAVYYCAADLTS TNPGSYIYIWAYDYWGQGTQVTVSS |
| RSVPMP22A4 | 355 | EVQLVESGGGLVQAGGSLRLSCGSSGRTFSRYAMGWFRQAPGKEREFVAAI SWSGGSTYYADSVKGRFTISRDNAKNTVYLQMSSLKPEDTAVYYCAADISS GNSGSYIYTWAYDYWGQGTQVTVSS |
| RSVPMP22E10 | 356 | EVQLVESRGGLVQAGGSLRLSCGSSGRTFSRYAMGWFRQAPGKEREFVAAI SWSGGSTYYADSVKGRFTISRDNAKNTVYLQMNSLKPEDTAVYYCAADISS GNSGSYIYTWAYDYWGQGTQVTVSS |
| RSVPMP22H4 | 357 | EVQLVESGGGLVQAGGSLRLSCGSSGRTFSRYAMGWFRQAPGKEHEFVAAI SWSGGSTYYADSVKGRFTISRDNAKNTVYLQMNSLKPEDTAVYYCAADISS GNSGSYIYTWAYDYWGQGTQVTVSS |
| RSVPMP15C5 | 358 | EVQLVESGGGWVQAGGSLRLSCAASGRAFSSYAMGWIRQAPGKEREFVAGI DQSGESTAYGTSASGRFIISRDNAKNTVYLLMNSLQSDDTAVYYCVADGVL ATTLNWDYWGQGTQVTVSS |
| RSVNC39 | 359 | EVQLVESGGGWVQAGGSLRLSCAASGRAFSSYAMGWIRQAPGKEREFVAGI DQSGESTAYGASASGRFIISRDNAKNTVHLLMNSLQSDDTAVYYCVADGVL ATTLNWDYWGQGTQVTVSS |
| RSVPMP7B9 | 360 | EVQLVESGGGLVQAGGSLRLSCAASGRTFSSYTMGWFRQAPGKEREFVAAI HWSGSNIYYGNSMKGRLTVSRDNAKNTAYLQMNSLKPEDTAVYYCAAALLG ENLQWKGAYDYWGQGTQVTVSS |
| RSVPMP15E11 | 361 | EVQLVESGGGLVQAGGSLRLSCVASGLTFEHYYMGWYRQAPKKEREFVADI SRAGASRYADSVKGRFTISRDNAKNTVYLQMNSLESEDTAVYYCAADYSHT FVYPSMVPYESDYWGQGTQVTVSS |
| RSVPMP7E7 | 362 | EVQLVESGGGLVQPGGSLRLSCSASGFTFSVYAMNWVRQAPGKGLEWVSGI SFSGGATMYADSVKGRFTISRDNAKNTLYLQMNSLKPEDTGVYYCAKGMSP NIEYAQGPVAYRGQGTQVTVSS |
| RSVPMP14H3 | 363 | EVQLVESGGGLVQAGGSLRLSCVASGRSFSNYPMGWFRQAPGKEREFVGAI SGSGSNLYYPGSWKGRFTISRDNAKNTGYLQMNSLKPEDTAVYYCALDHKA SGSYSSLSRPEEYDYWGQGTQVTVSS |
| RSVPMP24D6 | 364 | EVQLVESGGGLVQAGGSLRLSCAASGLTLDDYAIGWFRQGPGKAREGVSCI SSSDGSTYYADSVKGRFTMFSDNAKNTVALQMNSLKPEDTAVYYCTVLFGT SSCTYYSRRKYEYDYWGQGTQVTVSS |
| RSVPMP23E5 | 365 | EVQLMESGGGLVQAGGSLRLSCAASGGTFSSYAMGWFRQAPGEERDFVAAI GWSGNSPYYAQFVKGRFTISRDNAKNTVHLQMNSLKPEDTAVYYCAAAHNT MGSDYEGYDYWGQGTQVTVSS |
| RSVPMP8A6 | 366 | EVQLVESGGGLVQAGGSLRLSCAASGFTFDDYAIGWFRQAPGKEREGVSCI SNSDGSTYYADSVKGRFTISSDNAKNTVYLQMNSLKPEDTAVYYCAASRRG GSRWYGLSGSCYYGMDYWGKGTLVTVSS |
| RSVPMP14E2 | 367 | EVQLVESGGGLVQPGGSLRLSCAASGFTFGNYAMYWVRQAPGKGLEWVSAI NSGGGSTGYTDSVKGRFTISRDNAKNTLYLQMNSLKPEDTAVYYCAKDPYG SSWYGSPVYDYWGQGTQVTVSS |
| RSVPMP25F3 | 368 | EVQLVESGGGLVQAGGSLRLSCAASGFAVDDYAIGWFRQAPGKEREGVSSI SSSDGSPYYADSVKGRFTISSDNAKNTVYLQMNSLKPEDTAVYYCAAGRSL YAKGSWWLISSEYDYWGQGTQVTVSS |
| RSVPMP19A6 | 369 | EVQLVESGGGLVQPGGSLRLSCAASGSDFGISVMGWYRQAPEKRRELVATI TTFGITNYADSVKGRFTVSRDNAQNTVYLQMNSLKPDDTAVYYCYVRWYSS MWYEYWGQGTQVTVSS |
| RSVPMP23G1 | 370 | EVQLVESGGGLVQAGGSLRLSCAASGRTVSSSTMGWFRRAPGKEREFVAAI SWNGGTHYADYFVKGRFTLSRDNAKNTVYLQMNSLKPEDTAVYYCAAPISS YVGGNYYSAAFYHYWGQGTQVTVSS |
| RSVPMP15H8 | 371 | EVQLVESGGGLVQAGGSLRLSCAASGRSFSNYVLGWFRQAPGKEREFVAAI SFRGDSAIGAPSVEGRFTISRDNAKNTGYLQMNSLVPDDTAVYYCGAGTPL NPGAYIYDWSYDYWGRGTQVTVSS |

TABLE A-1-continued

Preferred $V_{HH}$ sequences or NANOBODY® ($V_{HH}$ sequences)(also referred herein as a sequence with a particular name or SEQ ID NO: X, wherein X is a number referring to the relevant amino acid sequence):

| Name | SEQ ID NO: | Amino acid sequence |
|---|---|---|
| RSVNC41 | 372 | EVQLVESGGGLVQAGGSLSISCAASGGSLSNYVLGWFRQAPGKEREFVAAINWRGDITIGPPNVEGRFTISKDNAKNTGYLQMNSLAPDDTAVYYCGADTPLNPGAYIYDWSYDYWGRGTQVTVSS |
| RSVPMP6A8 | 373 | EVQLAESGGGLVQPGGSLRLSCAASGFTFEYYAMGWFRQAPGKEREGVSCISSSDGSTYYADSVKGRFTISRDNAKNTVYLQMNSLKPEDTAVYYCAADHSRVYYRDYRQGRLCEEPYDYWGQGTQVTVSS |
| RSVPMP25H9 | 374 | EVQLVESGGGLVQAGGSLRLSCTASARRFSTSTMGWFRQAPGNEREFVACISWSGDITFYADSVKGRFTISRDNAKNAVYLQMNSLKPEDSAVYYCAFDARPAPYITNYKDPRAYDYWGQGTQVTVSS |
| RSVPMP8B11 | 375 | EVQLVESGGGLVQAGASLRLSCAASGRMFSSYGMGWFRQAPGKEREFVAAITWSGGYTYYLDSVKGRFTVSRDNAKNMVYLQMNSLKPEDTAVYYCAAGFQYYSTITNYARERDYDYWGQGTQVTVSS |
| RSVPMP17E1 | 376 | EVQLVESGGGLVQPGGSLRLSCVASGLTFSRYDMGWFRQAPGEERKFVAGINWSGGRTYYADSVKGRFTISRDNAKETVSLQMSGLKPEDTAVYYCAADQPPSTWLVEYFDYWGQGTRVTVSS |
| RSVPMP21A4 | 377 | EVQLVESGGGLVQAGGSLRLSCAASGLTFSRYDMGWFRQAPGEERQFVAGINWSGGRTYYADSVKGRFTISRDNAKEIVSLQMSGLKPEDTAVYYCAADQPPSTWLAEYFDYWGQGTRVTVSS |
| RSVPMP25A11 | 378 | EVQLVESGGGLVQAGGSLRLSCAASGLTFSRYDMGWFRQAPGEERKFVAGINWSGGRTYYADSVKGRFTISRDNAKETVSLQMSGLKPEDTAVYYCAADQPPSTWLVEYFDYWGQGTRVTVSS |
| RSVPMP25C8 | 379 | EVQLVESGGGLVQPGGSLRLSCAASGLTFSRYDMGWFRQAPGKEREFVAGINWSGGRTYYADSVKGRFTISRDNAKETVSLQMNGLKPEDTAVYYCAADQPPSTWLVEYFDYWGQGTQVTVSS |
| RSVNC23 | 380 | EVQLVESGGGLVQPGGSLRLSCAASGRTFSSIAMGWFRQAPGKEREFVAAISWSRGRTFYADSVKGRFIISRDDAANTAYLQMNSLKPEDTAVYYCAVDTASWNSGSFIYDWAYDHWGQGTQVTVSS |
| RSVPMP20A11 | 381 | EVQLVESGGGLVQAGGSLKLSCAASGRAFSSYTMGWFRQAPGKEREFVACVSRDGGTTYYAYSVKGRFTISRDNAKNTVYLQMNSLGPEDTAIYTCAAKENGMFITATQEQSYDYWGQGTQVTVSS |
| RSVPMP20A9 | 382 | EVQLVESGGGLVQAGGSLRLSCAASGRTFSSSFMAWFRQVLGSDREFVGGISPGGRFTYYADSRKGRFTISEDNANNTVYLQMHSVKPEDTATYYCAADTQFSGYVPKETNEYDYWGQGTQVTVSS |
| RSVPMP1F7 | 383 | EVQLVESGGGLVQPGGSLRLSCAASGFTFRNYAIGWFRQVPGKEREGVSCINSGGGRIDYADSVKGRFAISRDNAKSTVYLQMNSLKPEDTAVYYCAIDYTSSCPIYSGTDYWGKGTLVTVSS |
| RSVPMP20D6 | 384 | EVQLVESGGGLVQAGGSLRLSCAASGFTFDDYAIGWFRQAPGKEREGVSCIRCNDGSTYYADSVKGRFTISSDNAKNTVYLQMNSLKPEDTAVYYCAADFSLAQYKTIHTMPPYAMDYWGKGTLVTVSS |
| RSVPMP1F1 | 385 | EVQLVESGGGLVQAGGSLRLSCAASGPTFSSYTMGWFRQAPGKEREFVATIPWSGGIPYYSDSVKGRFTMSSDNAKNTVDLQMNSLKPEDTALYYCAGSSRIYVYSDSLSEGSYDYWGRGTQVTVSS |
| RSVPMP3D3 | 386 | EVQLVESGGGLVQAGGSLRLSCVASGRTFNNLAMGWFRQARGKEREFVATISWSHPNTYYTDSVKGRFTISRDDAQNAVYLQMNSLKPEDTAVYYCAANPSYVYSDYLSLAGYTYWGQGTQVTVSS |
| RSVPMP3E6 | 387 | EVQLVESGGGLVQPGGSLRLSCEASGFTFSSYWMYWVRQVPGKGLEWVSAISTGGGDTHYQDSVKGRFTISRDNAKNTLYLQMSSLKPEDTALYYCARNRDSGTSYITFSLTDFASWGQGTQVTVSS |
| RSVPMP1C8 | 388 | EVQLVESGGGLVQAGDSLRLSCAASGLTFSTYVMAWFRQAPGKERECVAAINWSGENIYYADSVKGRFTISRDNAKNTVYLQMNSLKPEDTADYLCAARKYYIHSDVVGNDYPYWGQGTQVTVSS |
| RSVPMP1A2 | 389 | EVQLVESGGGLVQAGGSLRLSCAASERTFSYYAMGWFRQAPGKEREFVATISRSGEWIYYKDAMKGRFTISRDNANNAVYLQMNSLQPEDTAIYYCAADSLGGFRSASDYYNTNTYAYWGQGTQVTVSS |
| RSVPMP1C5 | 390 | EVQLVESGGGLVQPGGSLRLSCAASGFTLDYYAIGWFRQAPGKEREGVSCFPSRYSSDGSTYYADSVKGRFTISRDNAKNTVYLQMNSLKPEDAAVYYCAADPSDWTCNVLEYDYWGQGTQVTVSS |

TABLE A-1-continued

Preferred $V_{HH}$ sequences or NANOBODY® ($V_{HH}$ sequences)(also referred herein as a sequence with a particular name or SEQ ID NO: X, wherein X is a number referring to the relevant amino acid sequence):

| Name | SEQ ID NO: | Amino acid sequence |
|---|---|---|
| RSVPMP20G5 | 391 | EVQLVESGGGLVQPGGSLKLSCAGSGSIFRFYDTAGWYRQAPGKQRELVAL ITDISGGYIKYADSVKGRFTISRDNAKNTVYLQMNSLKPEDTAVYYCNVHN YWGQGTQVTVSS |
| RSVPMP4D8 | 392 | EVQLVESGGGLVQAGGSPRLSCAASGGTFSSYGMGWFRQAPGKEREFVAAI SWSDSSTYYADSVKGRFTISRDNAKNTMYLQMNSLKPEDTAVYYCAAGSGI LNSGSYYYPWVYEYWGQGTQVTVSS |
| RSVPMP20B6 | 393 | EVQLVESGGGLVQAGGSLRLSCASSGSIYSINFMNWYRQAPGKQRELVASI TSGGYTNYADSVKGRFTISRDNAKNTVYLQMNSLKPEDTAVYICNAEGLII ATMDGGVNNDMDYWGKGTLVTVS |
| RSVPMP1D11 | 394 | EVQLVESGGGLVQPGGSLRLSCAASGNIFSIATMAWYRQAPGKQRELVASI SSSGYRIYADSVKGRFTSSRDNAKNTAYLQMNSLGPEDTAVYYCNFRDYEG NHWGQGTQVTVSS |
| RSVPMP20A8 | 395 | EVQLVESGGGLVQAGDSLRLSCAASGLTFSGYEMGWFRQAPGRERAFVAAI SQSGGTTSYAVSVKGRFTIARDNAKNTVYLQANNMKPEDTAVYYCAAALLL LPTTPSRVDYWGQGTQVTVSS |
| RSVPMP20E7 | 396 | EVQLVESGGGLVQVGDSLRLSCAASGLTFSGYEMGWFRQAPGKERAFVAAI SQSGGTTSYAVSVKGRFTIARDNAKNTVYLQANNMKPEDTAVYYCAAALLL LPTTPSRVDYWGQGTQVTVSS |
| RSVPMP20G8 | 397 | EVQLVESGGGLVQAGDSLRLSCAASGLTFSGYEMGWFRQAPGKERAFVAAI SQSGGTTSYAVSVKGRFTITRDNAKNTVYLQANNMKPEDTAVYYCAAALLL LPTTPSRVDYWGQGTQVTVSS |
| RSVPMP2D3 | 398 | EVQLVESGGGLVQAGDSLRLSCAASGLTFSGYEMGWFRQAPGKERAFVAAI SQSGGTTSYAVSVKGRFTIARDNAKNTVYLQADNMKPEDTAVYYCAAALLL LPTSPSRVDYWGQGTQVTVSS |
| RSVPMP2G5 | 399 | EVQLVESGGGLVQAGDSLRLSCAASGLTFSGYEMGWFRQAPGKERAFVAAI SQSGGTTSYAVSVKGRFTIARDNAKNTVYLQANNMKPEDTAVYYCAAALLL LPTTPSRVDYWGQGTQVTVSS |
| RSVPMP2A6 | 400 | EVQLVESGGGLVQPGGSLRLSCAASGFAFSTYAMGWVRQAPGKGLEWVSCI SNGGLRTMYADSVKGRFTISRDNAKNTLYLQMNSLKAEDTAVYYCAKYWAP WPMDVSRLDDYDNKGQGTQVTVSS |
| RSVPMP3A2 | 401 | EVQLVESGGGLVQAGGSLRLSCEASGRTFSSNAMGWFRQAPGKEREFVAAV TRWSGARTVYADSVKGRFTISRDNAENTVYLQMNSLKPEDTAVYTCAADST NRNSGAIYYPWAYDYWGQGTQVTVSS |
| RSVPMP4A8 | 402 | EVQLVESGGGLVQAGGSLRLSCEASGRTFSSYDMGWFRQAPGKEREFVAAV TRWSGARGVYADSVKGRFTISRDNAENTVHLQMNSLKPEDTAVYTCAADST NRNSGAVYYTWAYDYWGQGTQVTVSS |
| RSVPMP4F9 | 403 | EVQLVESGGGLVQAGGSLRLSCEASGRTFSNYAMGWFRQAPGKEREFVAVV SRWSGGRTLYADSVKGRFTISRDNAENLVYLQMNSLKPEDTAVYTCVADST NRNSGAYYYTWAYDHWGQGTQVTVSS |
| RSVPMP1A6 | 404 | EVQLVESGGGLVQAGGSLRLSCAASGRTFSSYAMGWFRQAPGKEREFVAAI WWSGGSTYYADSVKGRFTMSRDNAKNTVYLEMNNLKPEDTAVYYCAADTDS SNSGSYLYTWAYDYWGQGTQVTVSS |
| RSVPMP3C2 | 405 | EVQLVESGGGLVQAGGSLRLSCAASGRTFSPYAMGWFRQAPGKEREFVAAI SWSGGTTYYADSVKGRFTISRDNAKNTVYLQMNSLKPEDTAVYNCAADVSS TNSGSYIYTWAYDYWGQGTQVTVSS |
| RSVPMP4H9 | 406 | EVQLVESGGGLVQAGGSLRLSCTASGRTFSSYAMGWFRQAPGKERDFVAAI SWSGGSTYYADSVKGRFTISRDNAKNTVYLKMNSLKPEDTAVYYCAVDASS TNSGSFIYTWAYDYWGQGTQVTVSS |
| RSVPMP4B10 | 407 | KVQLVESGGGLVQAGGSLRLSCEASGGSFSSYAMGWFRQAPGKEREFVAAI SGWIGPRPVYADSVKGRFTISRDNAENTVYLQMNSLQPEDTAVYTCAADAT NRNSGAYFYTWAYDYWGQGTQVTVSS |
| 203B1 | 2431 | EVQLVESGGDLVQPGGSLRLSCAASGFTFRGYWMTWVRQAPGKGLEWVSSI NNVGEETYYVDSVKGRFTISRDNAKNTLYLQMNSLKSEDTAVYYCVKDWES SYAGYSPNSQGTQVTVSS |

TABLE A-1-continued

Preferred $V_{HH}$ sequences or NANOBODY® ($V_{HH}$ sequences)(also referred herein as a sequence with a particular name or SEQ ID NO: X, wherein X is a number referring to the relevant amino acid sequence):

| Name | SEQ ID NO: | Amino acid sequence |
|---|---|---|
| 203B2 | 2432 | EVQLVESGGDLVQPGGSLRLSCAASGFTFRGYWMTWVRQAPGKGLEWVSSINNIGEEAYYVDSVKGRFTISRDNAKNTLYLQMNSLKSEDTAVYYCVKDWASDYAGYSPNSQGTQVTVSS |
| 203G1 | 2433 | EVQLVESGGDLVQPGGSLRLSCAASGFTFSGYWMTWVRQAPGKGLEWVTSINNIGEETYYVDSVKGRFTISRDNAKNTLYLQMNSLKSEDTAVYYCVKDWASTYAGYRPNSQGTQVTVSS |
| 203H1 | 2434 | EVQLVESGGGVVQAGGSLRLSCAASGLTFDIYSMGWFRQQPGKEREFVASIGRSGNSTNYASSVKDRFTISRDNAKKLVYLEMNSLTVEDAAVYVCAAKDGPLITHYSTTSMYWGQGTQVTVSS |
| 203E12 | 2435 | EVQLVESGGGLVQPGGSLRLSCAASGFTFRGYWMSWVRQAPGKGLEWVSAINNVGDEVYYADSVKGRFTISRDNAKNTLYLQMNSLKSEDTAVYYCTRDWYNDPNKNEYKGQGTQVTVSS |
| 203E1 | 2436 | EVQLMESGGGLVQAGGSLRLSCVAPGRIFSSYTMGWFRQAPGKERDFVAAISTVGSTYYSDSVKGRCTISRDNANNTVALELNSLKPDDTAVYYCAABSHTYGSTYAATIDYEYDYWGQGTQVTVSS |
| 203A12 | 2437 | EVQLVESGGGLVQAGDSLTLSCIDSGRTFSDYPIGWFRQAPGKEREFVAAIYAIGGDVYYADSVKGRFTISRDNAKNTVYLQMSSLKPEDTAIYSCAVASGGGSIRSARRYDYWGQGTQVTVSS |
| 203A9 | 2438 | EVQLVESGGGLVQAGDSLRLSCIDSGRTFSDYPIGWFRQAPGKEREFVAAIYPTDDNPTGPNAYYADSVKGRFTISRDNAKNTVYLQMSSLKPEDTAIYSCAVASGGGSIISARRYDYWGQGTQVTVSS |
| 203B12 | 2439 | EVQLVESGGGLVQPGGSLRLSCAASGFTFSSYAMGWVRRAPGEGLEWVSSISSGGALPTYADSVKGRFTISRDNVKNTLYLQMNSLKPEDTAVYSCEKYAGSMWTSERDAWGQGTQVTVSS |
| 203D2 | 2440 | EVQLVESGGGLVQAGGSLRLSCAASGSTGSSTAMGWSRQAPGKQREWVASISSAGTIRYVDSVKGRFTISRDNAKNTGYLQMNSLKPEDTAVYYCYVVGNFTTYWGRGTQVTVSS |
| 203D9 | 2441 | EVQLVESGGGWVQAGDSLRLSCAASGRTLSSYAMAWFRQAPGKERDFVTGITWNGGSTYYADSVKGRFTISRDNAKNTVYLQMNSLKPEDTAVYYCAABQNTYGYMDRSDYEYDYWGQGTQVTVSS |
| 203G3 | 2442 | EVQLVESGGDLVQPGGSLRLSCAASGFTFRGYWMTWVRQAPGKGLEWVSSINNIGDEPYYVDSVKGRFTISRDNAKNTLYLQMNSLKSEDTAVYYCVKDWASDYAGYSPNSQGTQVTVSS |
| 203G9 | 2443 | EVQLVESGGGLVQPGGSLRLSCTASGFTFSSYWMDWVRQTPGKGLEYVSGISPSGGNTDYADSVKGRFTISRDNAKNTLYLQMNSLKPEDTALYYCRRSLTFTDTPDLRSQGTQVTVSS |
| 203G10 | 2444 | EVQLVESGGGWVQAGDSLRLSCAASGRTLSSYAMAWFRQAPGKERDFVTGITWNGGSTYYADSVKGRFTISRDNAKNTVYLQMNSLKPEDTAVYYCAADQNTYGYMDRSDYEYDYWGQGTQVTVSS |
| 203H9 | 2445 | EVQLVESGGGLVQPGGSLRLSCTGSGFTFSSYWMDWVRQTPGKDLEYVSGISPSGGNTDYADSVKGRFTISRDNAKNTLYLQMNSLQPEDTALYYCRRSLTLTDSPDLRSQGTQVTVSS |
| 203H10 | 2446 | EVQLVESGGGLVQAGDSLRLSCIDSGRTFSDYPIGWFRQAPGKEREFVAAIYAIGGDVYYADSVKGRFTISRDNAKNTVYLQMSSLKPEDTAIYSCAVASGGGSIRSARRYDYWGRGTQVTVSS |
| 202E4 | 2447 | EVQLVESGGGLVQAGGSLRLSCAASVSAFSEYAMGWYRQAPGKQREFVATINSLGGTSYADSVKGRFTISRDNAKNTVYLQMNSLKPEDTAVYYCTLYRANLWGQGTQVTVSS |
| 189E2 | 2448 | KVQLVESGGGLVQPGGSLRLSCAASGSIFSINAMGWYRQAPGKQRELVAHIASSGGSTIYADSVKGRFTISRDNAKNTVYLQMNSLKPEDTAVYYCNTRGPAAHEVRDYWGQGTQVTVSS |
| PRSVPMP20C3 | 2574 | EVQLVESGGGLVQAGGSLRLSCAASRSIFSFNTMGWYRQAPGKQRELVADITSGGSTVYADSVKGRFTISRDDKNTVYLQMNSLKPEDTAVYSCNAEGLIIATMNGGVNYGMDYWGKGTLVTVSS |

TABLE A-1-continued

Preferred $V_{HH}$ sequences or NANOBODY® ($V_{HH}$ sequences)(also referred herein as a sequence with a particular name or SEQ ID NO: X, wherein X is a number referring to the relevant amino acid sequence):

| Name | SEQ ID NO: | Amino acid sequence |
|---|---|---|
| PRSVPMP20C5 | 2575 | EVQLVESGGGLVQPGGSLRLSCAASGSIFSINAMGWHRQALGKQRELVAQSSSGGSTYYADSAKGRFTISRDNAKNMVYLQMNSLKPEDTAVYYCNVRTPEVHTIRDYWGQGTQVTVSS |
| PRSVPMP20B2 | 2576 | EVQLVESGGGLVQAGGSLRLSCEASGRTFSSYDMGWFRQAPGKEREFVAAVTRWSGARGVYADSVKGRFTISRDNAENTVHLQMNSLKPEDTAVYTCAADSTNRNSGAVYYTWAYDYWGQGTQVTVSS |
| PRSVPMP20C1 | 2577 | EVQLVESGGGLVQAGGSLRLSCAASGRTFSSFAMGWFRQAPGKEREFVAAISWSGGSTYYADSVKGRFTISGDNAKNTMYLQMNSLKPEDTAVYYCAADSEILNSGAYYYPWAYVYWGQGTQVTVSS |
| PRSVPMP1G8 | 2578 | EVQLVESGGGSVQAGGSLRLSCAASGGSFNRFGMGWFRRAPGKERDFVAAINLSGDTTYYVDSVQGRFTISRDNANNIMYLQMNLLKPEDTADYYCAADPDPITAWKQSGAGMDYWGKGTQVTVSS |
| PRSVNMP1A4 | 2579 | EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSS |
| PRSVPMP13E12 | 2580 | EVQLVESGGGLVQAGGSLRLSCAASGRTFSRYIMGWFRQAPGKEREFVGAISRSGDITSFADFVKGRFTMSRDNAKNTLYLQMNSLEPEDTAVYSCAANSDTYYIYSDIVVPERYDYWGQGTQVTVSS |
| PRSVPMP5C6 | 2581 | EVQLVESGGGLVQAGASLRLSCAASGLAFSRYAMGWFRQAPGKERESVAAISSSGDNIYYADSVKGQFTMSRDNAKSSVYLQMINLKPEDTAVYYCAAATSPLFVASDYFDASRYDYWGQGTQVTVSS |
| LG203E7 | 2682 | EVQLVESGGGLVQPGESLRLSCAFSGIVFEFYDMGWYRQAPGMQRELVANIASGGSTNLADAVKGRFTISRDNAQKKIDLQMNSLRREDTAVYYCNARYGSREYWGQGTQVTVSS |
| LG203G8 | 2683 | EVQLVESGGGLVQPGESLRLSCAFSGIVFEFYDMGWYRQAPGKQRELVANIASRGSTDLADSVKGRFTISRDNAQKKIDLQMNGLGREDTAVYYCNAQYGSREYWGQGTQVTVSS |
| LG211A10 | 2684 | EVQLVESGGGLAQAGGSLRLSCAVSGEAVGSSATGWYRAVSATERELVARIRSGGSTDYADSVKGRFTVSRDNAKNTVYLQMNSLKPEDTAVYYCNLVSYGEYFWGKGTLVTVSS |
| LG211A8 | 2685 | EVQLVESGGGLVQAGGSLRLSCAASGRTLSSYRLGWFRQAPGKEREFISTISWNGRSTYYADSVKGRFIFSEDEAKNTVHLQMNSLKPEDTAVYYCAAALIGGYYSDVDAWSYWGPGTQVTVSS |
| LG211B10 | 2686 | EVQLVESGGDLVQAGGSLRLSCVASGSTYSINAMGWYRQAPGKLRELVAAFRTGGSTDYADSVKGRFTISRDTAKNTVYLQMNSLKPEDTAVYYCNAEVIYYPYDYWGQGTQVTVSS |
| LG211B8 | 2687 | EVQLVESGGGLVQAGGSLRLSCAASGRTLSSYRLGWFRQAPGKEREFISTISWNGRSTYYADSVKGRFIFSEDEAKNTVHLQMNSLKPEDTAVYYCAAALIGGYYSDVDAWSYWGPGTQVTVSS |
| LG211C12 | 2688 | EVQLVESGGGLVQAGGSLRLSCTVSGDTFDNSAAGWYRATSETQRELVARIRSSGSTNYADSVKGRFTVSRDNAKNTVYLQMNSLKPEDTAVYYCNVVSYGEYFWGKGTLVTVSS |
| LG211C8 | 2689 | EVQLVESGGGSVQAGGSLRLSCAASGGTFNPYVMAWFRQAPGNEREFVARIRWSGGDAYYDDSVKGRFAITRDAAKNTVHLQMNSLKPEDTAVYYCAAATYGYGSYTYGGSYDLWGQGTQVTVSS |
| LG211D10 | 2690 | EVQLVESGGGLVQAGGSLRLSCAASGRTVSSYYMGWFRQAPGNEREFVAAFSWSSSKPYYADSVKGRFTISRDSAGNTVYLQMNSLKPEDTAVYWCGARQIGTYYSDYENYDYWGQGTQVTVSS |
| LG211D8 | 2691 | EVQLVESGGGLVQAGGSLRLSCAASGRAFSRYYMGWFRQAPGKEREVVAAFSWSGGMTYYADSVKGRFTMSRDSASDTVYLQMNSLKPEDTAVYYCGARQMGVYYSDYENYDYWGQGTQVTVSS |

TABLE A-1-continued

Preferred $V_{HH}$ sequences or NANOBODY® ($V_{HH}$ sequences)(also referred herein as a sequence with a particular name or SEQ ID NO: X, wherein X is a number referring to the relevant amino acid sequence):

| Name | SEQ ID NO: | Amino acid sequence |
|---|---|---|
| LG211E10 | 2692 | EVQLVESGGGLVQAGGSLRLSCAASGRTVSSYYMGWFRQAPGNEREFVAAF SWSGSKPYYADSVKGRFTISRDSAGNTVYLQMNSLKPEDTAVYWCGARQIG TYYSDYENYDYWGQGTQVTVSS |
| LG211E12 | 2693 | EVQLVESGGGLVQAGGSLRLSCAASGRTLSSYRLSWFRQAPGKEREFVATH SWDGRRTYYADSVKGRFTFSRDNAKNTVYLQLNSLKPEDTAVYHCAAATLI GGYYSDLDNYDYWGPGTQVTVSS |
| LG211E8 | 2694 | EVQLVESGGGLVQAGGSLRLSCAASGRAFSRYYMGWFRQAPGKEREVVAAF SWSGGMTYYADSVKGRFTMSRDSASDTVYLQMNSLKPEDTAVYYCGARQMG VYYSDYENYDYWGQGTQVTVSS |
| LG211H8 | 2695 | EVQLVESGGGLVQAGGSLRLSCAASGRTLSSYRLGWFRQAPGKEREFISTI SWNGRSTYYADSVKGRFIFSEDEAKNTVHLQMNSLKPEDTAVYYCAAALIG GYYSDVDAWSYWGPGTQVTVSS |
| LG212A10 | 2696 | EVQLVESGGGLVQAGGSLRLSCTVSGDTFDNSAAGWYRATSETQRELVARI RSSGSTNYADSVKGRFTVSRDNAKNTVYLQMNSLKPEDTAVYYCNVVSYGE YFWGKGTLVTVSS |
| LG212A12 | 2697 | EVQLVESGGGLVQAGGSLRLSCAVSGDTFDNSAAGWYRATSETQRELVARI RSSGSTNYADSVKGRFTVSRDNAKNTVYLQMNSLKPEDTAVYYCNVVSYGE YFWGKGTLVTVSS |
| LG212A2 | 2698 | EVQLVESGGGLVQAGGSLRLSCAASGRTFDTYFVGWFRQAPGKERDFVAAI SWSGDRTFYADSVKGRFTISRDNAKNTEYLQMNSLKPEDTAVYYCAAREYG RLYSDSEAYDYWGQGTQVTVSS |
| LG212A8 | 2699 | EVQLVESGGGSVQAGGSLRLSCAASGGTFNPYVMAWFRQAPGNEREFVARI RWSGGDAYYDDSVKGRFAITRDAAKNTVHLQMNSLKPEDTAVYYCAAATYG YGSYTYGGSYDLWGQGTQVTVSS |
| LG212B12 | 2700 | EVQLVESGGGLVQPGGSLRLSCAASGFTFGNYDMSWVRQAPGKGPEWVSGI NTGGSTLYADSVKGRFTISRDNAKNTLYLQMNSLKSEDTAVYYCAKDLYGS TWYTDYWSQGTQVTVSS |
| LG212B2 | 2701 | EMQLVESGGGLVQAGDSLRLSCAASGDTFSWYVMAWFRQAPGKEREFVTWI NRSGASTYYADSVKGRFTIFRDNDKNTVYLQMNSLKPEDTAVYYCAAGGFY GLRTTEERYDTWGQGTQVTVSS |
| LG212C12 | 2702 | EVQLVESGGGLVQPGGSLRLSCAASGFTFGSSDMSWVRQAPGKGPEWVSGI NSGGGRTLYADSVKGRFTISRDNAKNTLYLQMNSLKSEDTAVYYCATDLYG SSWYTDYWSQGTQVTVSS |
| LG212D10 | 2703 | EVQLVESGGGSVQAGGSLRLSCAASGGTFNPYVMAWFRQAPGNEREFVARI RWSGGDAYYDDSVKGRFAITRDAAKNTVHLQMNSLKPEDTAVYYCAAATYG YGSYTYGGSYDLWGQGTQVTVSS |
| LG212D12 | 2704 | EVQLVESGGGSVQAGGSLRLSCAASGGTFNPYVMAWFRQAPGNEREFVARI RWSGGDAYYDDSVKGRFAITRDAAKNTVHLQMNSLKPEDTAVYYCAAATYG YGSYTYGGSYDLWGQGTQVTVSS |
| LG212D2 | 2705 | EVQLVESGGGLVQPGGSLRLSCAASGFTFGSSDMSWVRQAPGKGPEWVSGI NSGGGITDYANSVKGRFTISRDNAKNTLYLQMNSLKPEDTAVYSCATDFWG STWSGLPGTQVTVSS |
| LG212E10 | 2706 | EVQLVESGGDLVQAGGSLRLSCVASGSTYSINAMGWYRQAPGKLRELVAAF RTGGSTDYADSVKGRFTISRDTAKNTVYLQMNSLKPEDTAVYYCNAEVIYY PYDYWGQGTQVTVSS |
| LG212E12 | 2707 | EVQLVESGGGLVQAGGSLRLSCAASGGTFSPYVMAWFRQAPGNEREFVARI RWSSINTAYDDSVKGRFTISRDNAKSTVYLQMDSLKPEDTAVYYCAAATYG YGSYTYQGSYDHWGQGTQVTVSS |
| LG212E6 | 2708 | EVQLVESGGGLVQPGGSLRLSCEASGFTFGSRDMHWVRQAPGKGGPEWVSG INSGASNTHYADSVKGRFTISRDNAKNTLYLQMNSLKAEDTAVYYCATEFW PGVYDTSTPGTQVTVSS |
| LG212F10 | 2709 | EVQLVESGGGSVQAGGSLRLSCAASGGTFNPYVMAWFRQAPGNEREFVARI RWSGGDAYYDDSVKGRFAITRDAAKNTVHLQMNSLKPEDTAVYYCAAATYG YGSYTYGGSYDLWGQGTQVTVSS |

TABLE A-1-continued

Preferred $V_{HH}$ sequences or NANOBODY® ($V_{HH}$ sequences)(also referred herein as a sequence with a particular name or SEQ ID NO: X, wherein X is a number referring to the relevant amino acid sequence):

| Name | SEQ ID NO: | Amino acid sequence |
|---|---|---|
| LG212F12 | 2710 | EVQLVESGGGLAQAGGSLRLSCAVSGEAVGSSATGWYRAVSATERELVARIRSGGSTDYADSVKGRFTVSRDNAKNTVYLQMNSLKPEDTAVYYCNLVSYGEYFWGKGTLVTVSS |
| LG212F6 | 2711 | EVQLVESGGGLVQPGGSLRLSCAASGFTFGSYDMSWVRQAPGKGSEWVSHINTGGGSTTYADSVKGRFTISRDNAKNTLYLQMSSLKPEDTAVYYCATGLYGGSTDDYWGQGTQVTVSS |
| LG212F8 | 2712 | EVQLVESGGDLVQAGGSLRLSCVASGSTYSINAMGWYRQAPGKLRELVAAFRTGGSTDYADSVKGRFTISRDTAKNTVYLQMNSLKPEDTAVYYCNAEVIYYPYDYWGQGTQVTVSS |
| LG212G10 | 2713 | EVQLVESGGGSVQAGGSLRLSCAASGGTFNPYVMAWFRQAPGNEREFVARIRWSGGDAYYDDSVKGRFAITRDAAKNTVHLQMNSLKPEDTAVYYCAAATYGYGSYTYGGSYDLWGQGTQVTVSS |
| LG212G2 | 2714 | EVQLVESGGGLVQPGGSLRLSCAASGFTFGSHDMSWVRQAPGKGSEWVSGIKSGGGSTLYADSVKGRFAISRDNAKNTLYLQMNSLKPEDTAVYYCATDLYGSTWYPGEDRGTQVTVSS |
| LG212H10 | 2715 | EVQLVESGGGSVQAGGSLRLSCAASGGTFNPYVMAWFRQAPGNEREFVARIRWSGGDAYYDDSVKGRFAITRDAAKNTVHLQMNSLKPEDTAVYYCAAATYGYGSYTYGGSYDLWGQGTQVTVSS |
| LG212H2 | 2716 | EVQLVESGGGLVQAGGSLRLSCAASGRTFDTYFVGWFRQAPGKERDFVAAISWSGDRTFYADSVKGRFTISRDNAKNTEYLQMNSLKPEDTAVYYCAAREYGRLYSDSEAYDYWGQGTQVTVSS |
| LG212H8 | 2717 | EVQLVESGGGLVQAGGSLRLSCTSSGSIFNFIMGWYRQAPGKQRELVADITRGDERNYLDAVKGRFIITRDSAKNTIYLQMNSLQPADSGVYWCHGLGVVSNREYWGQGTQVTVSS |
| IV121 | 3064 | QVQLQESGGGLVQPGGSLRLSCTASRTDISFNPMAWYRQAPGQQRELVASITSGGTTNYANSVKGRFTISRDNPKNTMYLQMNSLKPEDTAVYYCNGRGPRYTTTGWITDDYWGQGTQVTVSS |
| IV122 | 3065 | QVQLQQSGGGLVQPGGSLRLSCAASRSDFAFNPMGWYRQAPGKQRELVAVLTTGGTTNYADSVKGRFTISRDNARNTVYLQMNSLKPEDTAVYYCYARGPRKAPTGWITDDYWGQGTQVTVSS |
| IV123 | 3066 | QVQLQESGGGLVQPGGSLRLSCAASRSGFSFNPMGWYRQAPGKQRELVATITSGGTTNYADSVKGRFTISTDNAKTTVFLQMNSLKPEDTAVYYCNARGPRRGTAGWITDDYWGQGTQVTVSS |
| IV126 | 3067 | QVQLQESGGGLVQPGGSLRLSCAASRTDISFNPMGWYRQAPGKQRELVATMTSGGTTGYADSVKGRFTISRDNPKNTLYLQMNSLEPEDTAVYYCHARGPRYATTGWFTDDYWGQGTQVTVSS |
| IV127 | 3068 | QVQLQESGGGLVQPGGSLRLSCAASRSGFVFNPMGWYRQAPGKQRELVAVITASLTTNYADSVKGRFTISRDNTGNTAYLQMNSLKPEDTAVYYCYGRGPRKAPTGWITDDYWGQGTQVTVSS |
| IV131 | 3069 | QVQLQQSGGGLVQAGGSLRLSCAASGSGFSFNPMGWYRQAPGKQRELVASITSGGTTNYVDSVKGRFTISRGNAKNTVYLQMNSLKPEDTAVYYCAAEGPRRRGSTWYTDNYWGQGTQVTVSS |
| IV132 | 3070 | QVQLQESGGGLVQPGGSLRLSCAASVSGFIFNPMGWYRQARGKQREEVAVLTTGGTTKYADSVKDRFTISRDNARNTVDLQMNSLKPEDTAVYYCYARGPRHVPTGWITDDYWGQGTQVTVSS |
| IV133 | 3071 | QVQLQQSGGGLVQPGGSLRLSCAASSSGFSFNPMGWYRQAPGKQRELVATMTSGGTTNYADSVKGRFTISRDNAKTTVYLQMNSLKPEDTAVYYCNARGPRRATTGWITDDYWGQGTQVTVSS |
| IV134 | 3072 | QVQLQESGGGLVQAGGSLRLSCAASGSGFSFNPMGWYRQAPGKQRELVASITSGGTTNYVDSVKGRFTISRGNAKNTVYLQMNSLKPEDTAVYYCAAEGPRRRGSTWYTDNYWGQGTQVTVSS |
| IV135 | 3073 | QVQLQQSGGGLVQPGGSLRLSCAASRGDISFNPMGWYRQAPGKQRELVATITNGGTTNYADSVKGRFTISRDNAETAVYLQMNSLKPEDTAVYYCNARGPRHATTGWYTDDYWGQGTQVTVSS |

TABLE A-1-continued

Preferred $V_{HH}$ sequences or NANOBODY® ($V_{HH}$ sequences)(also referred herein as a sequence with a particular name or SEQ ID NO: X, wherein X is a number referring to the relevant amino acid sequence):

| Name | SEQ ID NO: | Amino acid sequence |
|---|---|---|
| IV136 | 3074 | QVQLQESGGGLVQPGGSLRLSCAASRSGFSFNPMGWYRQAPGKQRELVATI TSGGTTNYADSVKGRFTISTDNAKTTVYLQMNSLKPEDTAVYYCNGRGPRR ATTGWITDDYWGQGTQVTVSS |
| IV140 | 3075 | QVQLQESGGGLVQPGGSLRLSCAASRSDFAFNPMGWYRQAPGKQRELVAVL TTGGTTNYADSVKGRFTISRDNARNTVYLQMNSLKPEDTAVYYCYARGPRK APTGWITDDYWGQGTQVTVSS |
| IV144 | 3076 | QVQLQQSGGGLVQAGGSLRLSCAASGNIISFNPMGWHRQAPGKQRELVASI TSGGSISYVDSVKGRFTISRDSAKNTIYLQMNSLKPEDTAVYFCAGEGPRR RGSTWYTDTYWGQGTQVTVSS |
| IV156 | 3077 | QVQLQQSGGGLVQPGGSLRLSCAASRSGFSFNPMGWYRQAPGKQRELVATI TSGGTTNYADSVKGRFTISTDNAKTTVFLQMNSLKPEDTAVYYCNGRGPRR GTAGWFTDDYWGQGTQVTVSS |
| IV157 | 3078 | QVQLQQSGGGLVQPGGSLRLSCAASRSDISFNPMGWYRQAPGKQRELVATI SNGGTTNYADSVKGRFTISQDNAKTTVYLQMNSLKPEDTAVYYCNGRGPRY ATTGWYTDDYWGQGTQVTVSS |
| IV160 | 3079 | QVQLQESGGGLVQPGGSLRLSCAASRSDISFNPMGWYRQAPGKQRELVATI SNGGTTNYADSVKGRFTISQDNAKTTVYLQMNSLKPEDTAVYYCNGRGPRY ATTGWYTDDYWGQGTQVTVSS |
| IV124 | 3080 | QVQLQESGGGLVQPGGSLRLSCAASGSIFSINRMGWYRQAPGKQRELVAAI TYGGSTNYADSVKGRFTISRDNAKNTVYLQMNSLKPEDTAVYYCNAGSTYS PFGDKYDYWGQGTQVTVSS |
| IV125 | 3081 | QVQLQQSGGGLVQAGGSLRLSCAASGSAFSINTMGWYRQAPGKQRELVAVI SSGSGGSTNYADSVKGRFTISRDNAKNTVYLHMNSLKPEDTAVYYCNAGSR FNPFGSAYDYWGQGTQVTVSS |
| IV145 | 3082 | QVQLQQSGGGLVQPGGSLRLSCAASGSTFSINAMGWYRQAPGKQRELVAAI SSGGSTNYADSVKGRFTISRDNAKNTVYLQMNSLKPEDTAVYYCNAGSRFN PEGSAYDYWGQGTQVTVSS |
| IV146 | 3083 | QVQLQQSGGGLVQAGGSLRLSCAASGSSFSINAMGWYRQAPGKQRELVAAI SSGGSANYADSVKGRFTISRDNAKNTVYLQMNSLKPEDTAVYYCNAGSRFN PEGSAYDYWGQGTQVTVSS |
| IV147 | 3084 | QVQLQESGGGLVQAGGSLRLSCAASGSTFSINAMGWYRQAPGKQRELVAAI SSGGSTNYADSVKGRFTISRDNAKNTVYLQMNSLKPEDTAVYYCNAGSRFN PEGSAYDYWGQGTQVTVSS |
| IV151 | 3085 | QVQLQESGGGLVQAGDSLRLSCAASGRTFNSLTMAWFRQAPGKDRDFVSVV NWDGDRTNYADSVKGRFTIFRDNAKNTVYLQMNGLKPDDTAIYRCAARWDY GLWRPSTYNYAYWGQGTQVIVSS |
| IV153 | 3086 | QVQLQESGGGLVQAGGSLRLSCAFSGDTFSFYTLGWFRQAPGKEREFVAAT SNIGGYIYYGDSVKGRFTISGDNAKNTVYLQMSSLKPEDTAVYYCAATLRS GSMWYQNVRVNDNPYWGQGTQVTVSS |
| IV154 | 3087 | QVQLQESGGGLVQAGGSLRLSCAASGRPFSSAAMGWFRQAPGKEREFVSAI SYTGDVTRYADSVKGRFTISRDNTRNTLTLEMNSLKPEDTAVYYCAARTYA GVRAHTYDYDYWGQGTQVTVSS |
| IV155 | 3088 | QVQLQESGGGLVQAGGSLRLSCAASGRSLSRYAMGWFRQAPGKEREFVATK TSGGVTYYGASVKGRFTISRDNAKNMVYLQMNSLNPEDTAIYYCAAGTDAI FKPWMLPDYWGQGTQVTVSG |
| IV1 | 3089 | QVQLQESGGGLVETGGSLRLSCAASGRTFGGYALAWFRQAPGKGREFVAAV TWTSGTTNYAGSVKDRFTVSRDNAGNTMYLQMNSLRPEDTAVYICGAASGY RSPDRLSEPNWVNYWGQGTQVTVSS |
| IV2 | 3090 | QVQLQESGGGLVQTGGSLRLSCAASGRTFGGYAMAWFRQAPRKGREFVASV TWNGGATDYAGSVKDRFTVSRDTANNTMYLQMNSLKPEDTAVYICGAASGY RSTDRLSDPGWTNYWGQGTQVTVSS |
| IV3 | 3091 | QVQLQESGGGLVQTGGSLRLSCAASGRTFGGYAMAWFRQVPGKGREFVAAV TWSSGTTNYARSVKDRFIVSRDNANNTMYLQMNSLKPEDTAVYICGAASGY RSTDRLSEPAWINYWGQGTQVTVSS |

TABLE A-1-continued

Preferred $V_{HH}$ sequences or NANOBODY® ($V_{HH}$ sequences)(also referred herein as a sequence with a particular name or SEQ ID NO: X, wherein X is a number referring to the relevant amino acid sequence):

| Name | SEQ ID NO: | Amino acid sequence |
|---|---|---|
| IV4 | 3092 | QVQLQESGGGLVQTGGSLRLSCAASGRTFGGYAMAWFRQAPGKGREFVAAV TWSSGTTNYAGSVKDRFTVSRDNANNTMYLQMNSLKPEDTAVYICGAASGY RSTDRLSTPEWINYWGQGTQVTVSS |
| IV6 | 3093 | QVQLQESGGGLVQTGGSLRLSCAASGRTFGGYAMAWFRQAPGKGREFVAAV TWSAGTTNYAGSVKDRFTVSRDNANNTMYLQMNSLKPEDTAVYICGAATGY RSTDRLAEPGWVNYWGQGTQVTVSS |
| IV7 | 3094 | QVQLQQSGGGLVQTGGSLRLSCAASGRTFGGYAMAWFRQAPGKGREFVAAV TWSAGTTNYAGSVKDRFTVSRDNANNTMYLQMNSLKPEDTAVYICGAASGY RSTDRLSEPAWINYWGQGTQVTVSS |
| IV9 | 3095 | QVQLQESGGGLVQTGGSLRLSCAASGRTFGGYAMAWFRQAPGKGREFVAAV TWSAGTTNYAGSVKDRFTVSRDNANNTMYLQMNSLKPEDTAVYICGAATGY RSTDRLTEPAWVNYWGQGTQVTVSS |
| IV10 | 3096 | QVQLQESGGGLVQAGGSLRLSCATSGRPFGGYAMAWFRQAPGKGREFVAAV TWSAGTTNYAGSVKDRFTVSRDNANNTMYLQMNSLKPEDTAVYICGAATGY RSTDRLSDPNWVNYWGQGTQVTVSS |
| IV11 | 3097 | QVQLQESGGGLVQAGGSLRLSCAASGRTFGGYAMAWFRQAPGKGREFVAAV TWSSGTTNYAGSVKDRFTVSRDNANNTMYLRMNSLKPEDTAVYICGAASGY RSTDRLSDAAWINYWGQGTQVTVSS |
| IV12 | 3098 | QVQLQQSGGGLVQTGGSLRLSCAASGRTFGGYAMAWFREAPGKGREFVAAV TWSSGTTNYAGSVKDRFTVSRDNANNTMYLQMNSLKPEDTAVYICGAASGY RSTDRLSTPEWINYWGQGTQVTVSS |
| IV16 | 3099 | QVQLQESGGGLVQTGGSLRLSCAASGRTFGGYAMAWFRQAPGKGREFVAAV TWSSGTTNYAGSVKDRFTVSRDNGNNTMYLQMNSLKPEDTAVYICGVASGY RSTDRLSEPGWINYWGQGTQVTVSS |
| IV24 | 3100 | QVQLQESGGGLVQTGGSLRLSCAASGRTFGGYAMAWFRQAPGKGREFVAAI TWSAGTTNYADSMKDRFTVSRDTANNTMYLEMNRLKPDDTAVYICGAATGY RSTDRLSTPAWINYWGQGTQVTVSS |
| IV26 | 3101 | QVQLQESGGGLVRTGDSLRLSCAASGRTFNGYAMAWFRQAPGKGREFVAAV TWSSGTTNYAGSVKDRFTVSRDNANNTMYLQMNSLKPEDTAVYICGAASGY RSTDRLSDPAWTNYWGQGTQVTVSS |
| IV30 | 3102 | QVQLQESGGGLVETGGSLRLSCAASGRTFGGYAMAWFRQAPGKGREFVAAV TWTSGTTNYAGSVKDRFTVSRDNANNTMYLQMNSLKPEDTAVYICGAASGY RSPDRLSEPEWINYWGQGTQVTVSS |
| IV34 | 3103 | QVQLQESGGGLVQTGGSLRLSCAASGGTFGGYAMAWFRQAPGKGREFVASV IWNGGTTNYLDSVKDRFTVSRDMANNTMYLQMNSLKPEDTAVYICGAASGY RSTDRLSEPGWVNYWGQGTQVTVSS |
| IV14 | 3104 | QVQLQESGGGLVQAGGSLRLSCAASGRTLNNYAMGWFRQAPGAEREFVGAI SASGDSTQYTESVQGRFTISKDNAKSTVYLDMNSLKPEDTAVYYCAADRKT LAYYTSRLRSRYDYWGQGTQVTVSS |
| IV15 | 3105 | QVQLQQSGGGLVQAGGSLRLSCAASGGTLNNYAMGWFRQAPGAEREFVGAI SAGGDSTQYTESVQGRFTISKDNAKSTVYLDMNSLKPEDTAVYYCAADRKT LTYYTSRLRSRYDYWGQGTQVTVSS |
| IV17 | 3106 | QVQLQESGGGLVQAGGSLRLSCAASGRTLNNYAMGWFRQAPGAEREFVGAI SASGDSTQYTESVQGRFTISKDNAKSTVYLDMNSLKPEDTAVYYCAADRKT LTFYTSRLRSRYDYWGQGTQVTVSS |
| IV18 | 3107 | QVQLQQSGGGLVQAGGSLRLSCAASGRTLNNYAMGWFRQAPGAEREFVGAI SASGDSTQYTESVQGRFTISKDNAKSTVYLDMNSLKPEDTAVYYCAADRKT LTFYTSRLRSRYDYWGQGTQVTVSS |
| IV29 | 3108 | QVQLQESGGGLVQAGGSLRLSCVASGRTLDNYAMGWFRQAPGAEREFVGAI SANGEDTQYTESVQGRFTISKDNAKSTVYLDMNSLKPEDTAVYYCAADRKT LTYYTSRLRSRYEYWGQGTQVTVSS |
| IV31 | 3109 | QVQLQQSGGGLVQAGGSLRLSCAASGRTLNNYAMGWFRQAPGAEREFVGAI SASGDSTQYTESVQGRFTISKDNAKSTVVLDMNSLKPEDTAVYYCAADGKT LTFYTSRLRSRYDYWGQGTQVTVSS |

TABLE A-1-continued

Preferred $V_{HH}$ sequences or NANOBODY® ($V_{HH}$ sequences)(also referred herein as a sequence with a particular name or SEQ ID NO: X, wherein X is a number referring to the relevant amino acid sequence):

| Name | SEQ ID NO: | Amino acid sequence |
|---|---|---|
| IV33 | 3110 | QVQLQQSGGGLVQAGGSLRLSCAASGRTLNNYAMGWFRQAPGAEREFVGAISASGDSTQYTESVQGRFSISKDLAKSTVYLDMNSLKPEDTAVYYCAADQKTLTFYTSRLRSRYDYWGQGTQVTVSS |
| IV35 | 3111 | QVQLQESGGGLVQAGGSLRLSCAASGRTLNNYAMGWFRQAPGAEREFVGAISASGDSTDYTESVQGRFTISKDNAKSTVYLDMNSLKPEDTAVYYCAADRKTLTFYTSRLRSRYDYWGQGTQVTVSS |
| IV36 | 3112 | QVQLQESGGGLVQAGGSLRLSCAASGRTLNNYAMGWFRQAPGAEREFVGAISASGDSTQYTESVQGRFTISKDYAKSTVYLDMNSLKPEDTAVYYCAADQKTLTYYTSRLRSRYDYWGQGTQVTVSS |
| IV40 | 3113 | QVQLQESGGGLVQAGGSLRLSCAASGHTLNNYAMGWFRQGPGAEREFVGAISASGDSTQYTESVQGRFTISKDNAKRTVYLDMNSLKPEDTAVYYCAADGKTLTYYTSRLRSQYDYWGQGTQVTVSS |
| IV42 | 3114 | QVQLQQSGGGLVQAGESLRLSCAASGRTLNNYAMGWFRQAPGAEREFVGAISASGDSTQYTESVQGRFTISKDNAKSTVYLDMNSLKPEDTAVYYCAADRKTLTFYTSRLRSRYDYWGQGTQVTVSS |
| IV8 | 3115 | QVQLQESGGGLVQAGGFLRLSCAASGRSFNTYAMGWFRQAPGKEREFVAGITRSGTATDYADSVKGRFTISRDNARNTVYLQMNRLKSEDSAVYYCAAHASYDRMIYSEYKYWGQGTQVTVSS |
| IV21 | 3116 | QVQLQQSGGGLVQAGGFLRLSCAASGRSFNTYAMGWFRQAPGKEREFVAGITRSGTATDYIDSVKGRFTISRDNARDTVYLQMNRLNPEDSAVYYCAAHANYDRMINSEYKYWGQGTQVTVSS |
| IV23 | 3117 | QVQLQESGGGLVQAGGFLRLSCAASGRSFNTYAMGWFRQAPGKEREFVAGITRSGTATDYIDSVKGRFTISRDNARDTVYLQMNRLNPEDSAVYYCAAHANYDRMINSEYKYWGQGTQVTVSS |
| IV45 | 3118 | QVQLQQSGGGLVQAGGFLRLSCAASGRSFNTYAVGWFRQAPGKEREFVAGITRSGTATDYADSVKGRFTISRDNARNTVYLQMNRLKPEDSAVYYCAAHASYDRMINSEYKYWGQGTQVTVSS |
| IV47 | 3119 | QVQLQQSGGGLVQAGGFLRLSCAASGRSFNTYAMGWFRQAPGKEREFVAGITRSGTATEYADSVKGRFTISRDNARNTVLLQMNRLKPEDSAVYYCAAHANYDRMINSEYKYWGQGTQVTVSS |
| IV48 | 3120 | QVQLQESGGGLVQAGGFLRLTCAASGRSFNTYAMGWFRQAPGKDRKFVAGITRSGTVTDYADSVKGRFTISRDNARNTVYLQMNRLKPEDSAVYYCAGHASYDRMINSEYKYWGQGTQVTVSS |
| IV50 | 3121 | QVQLQESGGGLVQAGGFLRLSCAASGRSFNTYAMGWFRQAPGKEREFVAGITRSGTATDYADSVKGRFTISRDNARNTVYLQMNRLKPEDSAVYYCAAHASYDRMIYSEYKYWGQGTQVTVSS |
| IV22 | 3122 | QVQLQESGGGLVQAGDSLRLSCAASGPSFNNGAMSWFRQAPGKEREFVAAIRWSGGGIRYADSVKGRFTISRDNAKNTLYLQMNSLKPEDTAVYYCAIDPRADLVATMTSIRYWGQGTQVTVSS |
| IV37 | 3123 | QVQLQESGGGLVQAGDSLRLSCAAPGRSFSGGAMSWFRQVPGKEREFVAAIRWSGGGIRYADSVKGRFTISRDNAKNTFYLQMNSLKPEDTAVYYCAIDPRADLVATMTSIRYWGQGTQVTVSS |
| IV38 | 3124 | QVQLQESGGGLVQAGGSLRLSCAASGPSFNNGAMSWFRQAPGKEREFVAAIRWSGGGIRYADSVKGRFTISRDNAKNTLYLQMNSLKPEDTAVYYCAIDPRADLVATMTSIRYWGQGTQVTVSS |
| IV5 | 3125 | QVQLQQSGGGLVQAGGSLRLSCAASGRTFSTTGMGWFRQAPGKEREFVAAFWWTGGQTFYADSVKGRFTISGDNAGNTVDLQMNSLKPEDTAVYACAAMSKPRNLWRTDSYDYWGQGTQVTVSS |
| IV27 | 3126 | QVQLQESGGGLVQAGGSLRLSCAASGSTFSTYAMGWFRQAPGKEREFVAAFWWTDEQTFYADSVKGRFTISRGNAKNTVDLQMNSLKPEDTAVYACAAMSKPYNLWRTDSYDYWGQGTQVTVSS |
| IV25 | 3127 | QVQLQQSGGGLVQSGGSLSLSCAASGITLNNRVVGWFRQAPGKEREFVGRIMWSVGDTFYARSVKGRFTISRDNAKNTMYLQMNALKPEDTAVYYCAAARDPDLYTGQYEYWGQGTQVTVSS |

TABLE A-1-continued

Preferred $V_{HH}$ sequences or NANOBODY® ($V_{HH}$ sequences)(also referred herein as a sequence with a particular name or SEQ ID NO: X, wherein X is a number referring to the relevant amino acid sequence):

| Name | SEQ ID NO: | Amino acid sequence |
|---|---|---|
| IV28 | 3128 | QVQLQESGGGLVQPGGSLRLSCSASGFAFDDYAMSWVRQAPGKGLEWVSSI NWNGGSTYYAESMKGRFTISRDSAKNTLYLQMNSLKSEDTAVYYCAKGEGS ANWGLDFGSWGQGTQVTVSS |

In the above Table A-1, SEQ ID NO's: 126 to 157, 2431 to 2447, 2682 to 2683 and 3064 to 3128 refer to amino acid sequences of the invention that are directed to and/or specifically bind to hemagglutinin H5 of influenza; SEQ ID NO's: 158 to 236, 248 to 407, 2448 and 2574 to 2581 refer to amino acid sequences of the invention that are directed to and/or specifically bind to the F protein of hRSV; and SEQ ID NO's: 237 to 247 and 2684 to 2717 refer to amino acid sequences of the invention that are directed to and/or specifically bind to the G protein of rabies virus.

In particular, the invention in some specific aspects provides:

- amino acid sequences that are directed against (as defined herein) an envelope protein of a virus and that have at least 80%, preferably at least 85%, such as 90% or 95% or more sequence identity with at least one of the amino acid sequences of SEQ ID NO's: 126 to 407, 2431 to 2448, 2574 to 2581, 2682 to 2717 and 3064 to 3128 (see Table A-1); these amino acid sequences may further be such that they neutralize binding of the binding partner (such as the viral receptor) to an envelope protein of a virus; and/or compete with the binding partner (such as the viral receptor) for binding to an envelope protein of a virus; and/or are directed against an interaction site (as defined herein) on an envelope protein of a virus (such as the viral receptor binding site);
- amino acid sequences that cross-block (as defined herein) the binding of at least one of the amino acid sequences of SEQ ID NO's: 126 to 407, 2431 to 2448, 2574 to 2581, 2682 to 2717 and 3064 to 3128 (see Table A-1) to an envelope protein of a virus and/or that compete with at least one of the amino acid sequences of SEQ ID NO's: 126 to 407, 2431 to 2448, 2574 to 2581, 2682 to 2717 and 3064 to 3128 (see Table A-1) for binding to an envelope protein of a virus. Again, these amino acid sequences may further be such that they neutralize binding of the binding partner (such as the viral receptor) to an envelope protein of a virus; and/or compete with the binding partner (such as the viral receptor) for binding to an envelope protein of a virus; and/or are directed against an interaction site (as defined herein) on an envelope protein of a virus (such as the viral receptor binding site);

which amino acid sequences may be as further described herein (and may for example be NANOBODIES® ($V_{HH}$ sequences)); as well as polypeptides of the invention that comprise one or more of such amino acid sequences (which may be as further described herein, and may for example be bispecific and/or biparatopic polypeptides as described herein), and nucleic acid sequences that encode such amino acid sequences and polypeptides. Such amino acid sequences and polypeptides do not include any naturally occurring ligands.

Accordingly, some particularly preferred NANOBODIES® ($V_{HH}$ sequences) of the invention are NANOBODIES® ($V_{HH}$ sequences) which can bind (as further defined herein) to and/or are directed against an envelope protein of a virus and which:

i) have at least 80% amino acid identity with at least one of the amino acid sequences of SEQ ID NO's: 126 to 407, 2431 to 2448, 2574 to 2581, 2682 to 2717 and 3064 to 3128 (see Table A-1), in which for the purposes of determining the degree of amino acid identity, the amino acid residues that form the CDR sequences are disregarded. In this respect, reference is also made to Table B-1, which lists the framework 1 sequences (SEQ ID NO's: 408 to 689, 2449 to 2466, 2582 to 2589, 2718 to 2753 and 3129 to 3193), framework 2 sequences (SEQ ID NO's: 972 to 1253, 2485 to 2502, 2598 to 2605, 2790 to 2825 and 3259 to 3323), framework 3 sequences (SEQ ID NO's: 1536 to 1817, 2521 to 2538, 2614 to 2621, 2862 to 2897 and 3389 to 3453) and framework 4 sequences (SEQ ID NO's: 2100 to 2381, 2557 to 2573, 2630 to 2637, 2934 to 2969 and 3519 to 3583) of the NANOBODIES® ($V_{HH}$ sequences) of SEQ ID NO's: 126 to 407, 2431 to 2448, 2574 to 2581, 2682 to 2717 and 3064 to 3128 (see Table A-1) (with respect to the amino acid residues at positions 1 to 4 and 27 to 30 of the framework 1 sequences, reference is also made to the comments made below. Thus, for determining the degree of amino acid identity, these residues are preferably disregarded);

and in which:

ii) preferably one or more of the amino acid residues at positions 11, 37, 44, 45, 47, 83, 84, 103, 104 and 108 according to the Kabat numbering are chosen from the Hallmark residues mentioned in Table B-2 below.

In these NANOBODIES® ($V_{HH}$ sequences), the CDR sequences are generally as further defined herein.

Again, such NANOBODIES® ($V_{HH}$ sequences) may be derived in any suitable manner and from any suitable source, and may for example be naturally occurring $V_{HH}$ sequences (i.e. from a suitable species of Camelid) or synthetic or semi-synthetic amino acid sequences, including but not limited to "humanized" (as defined herein) NANOBODIES® ($V_{HH}$ sequences), "camelized" (as defined herein) immunoglobulin sequences (and in particular camelized heavy chain variable domain sequences), as well as NANOBODIES® ($V_{HH}$ sequences) that have been obtained by techniques such as affinity maturation (for example, starting from synthetic, random or naturally occurring immunoglobulin sequences), CDR grafting, veneering, combining fragments derived from different immunoglobulin sequences, PCR assembly using overlapping primers, and similar techniques for engineering immunoglobulin sequences well known to the skilled person; or any suitable combination of any of the foregoing as further described herein. Also, when a NANOBODY® ($V_{HH}$ sequence) comprises a $V_{HH}$ sequence, said NANOBODY® ($V_{HH}$ sequence) may be suitably humanized, as further described herein, so as to provide one or more further (partially or fully) humanized NANOBODIES® ($V_{HH}$ sequences) of the invention. Similarly, when a NANO- BODY® ($V_{HH}$ sequence) comprises a synthetic or semi-synthetic sequence (such as a partially humanized sequence), said NANOBODY® ($V_{HH}$ sequence) may optionally be further suitably humanized, again as described herein, again so as to provide one or more further (partially or fully) humanized NANOBODIES® ($V_{HH}$ sequences) of the invention.

In particular, humanized NANOBODIES® ($V_{HH}$ sequences) may be amino acid sequences that are as generally defined for NANOBODIES® ($V_{HH}$ sequences) in the previous paragraphs, but in which at least one amino acid residue is present (and in particular, in at least one of the framework residues) that is and/or that corresponds to a humanizing substitution (as defined herein). Some preferred, but non-limiting humanizing substitutions (and suitable combinations thereof) will become clear to the skilled person based on the disclosure herein. In addition, or alternatively, other potentially useful humanizing substitutions can be ascertained by comparing the sequence of the framework regions of a naturally occurring $V_{HH}$ sequence with the corresponding framework sequence of one or more closely related human $V_H$ sequences, after which one or more of the potentially useful humanizing substitutions (or combinations thereof) thus determined can be introduced into said $V_{HH}$ sequence (in any manner known per se, as further described herein) and the resulting humanized $V_{HH}$ sequences can be tested for affinity for the target, for stability, for ease and level of expression, and/or for other desired properties. In this way, by means of a limited degree of trial and error, other suitable humanizing substitutions (or suitable combinations thereof) can be determined by the skilled person based on the disclosure herein. Also, based on the foregoing, (the framework regions of) a NANOBODY® ($V_{HH}$ sequence) may be partially humanized or fully humanized.

Some particularly preferred humanized NANOBODIES® ($V_{HH}$ sequences) of the invention are humanized variants of the NANOBODIES® ($V_{HH}$ sequences) of SEQ ID NO's: 126 to 407, 2431 to 2448, 2574 to 2581, 2682 to 2717 and 3064 to 3128 (see Table A-1), of which the amino acid sequences of SEQ ID NO's: 2999 to 3015 (see Table A-8) are some especially preferred examples.

Thus, some other preferred NANOBODIES® ($V_{HH}$ sequences) of the invention are NANOBODIES ($V_{HH}$ sequences) which can bind (as further defined herein) to an envelope protein of a virus and which:

i) are a humanized variant of one of the amino acid sequences of SEQ ID NO's: 126 to 407, 2431 to 2448, 2574 to 2581, 2682 to 2717 and 3064 to 3128 (see Table A-1);

and/or ii) have at least 80% amino acid identity with at least one of the amino acid sequences of SEQ ID NO's: 126 to 407, 2431 to 2448, 2574 to 2581, 2682 to 2717 and 3064 to 3128 (see Table A-1) and/or at least one of the amino acid sequences of SEQ ID NO's: 2999 to 3015 (see Table A-8), in which for the purposes of determining the degree of amino acid identity, the amino acid residues that form the CDR sequences are disregarded;

and in which:

iii) preferably one or more of the amino acid residues at positions 11, 37, 44, 45, 47, 83, 84, 103, 104 and 108 according to the Kabat numbering are chosen from the Hallmark residues mentioned in Table B-2 below.

According to another specific aspect of the invention, the invention provides a number of stretches of amino acid residues (i.e. small peptides) that are particularly suited for binding to an envelope protein of a virus. These stretches of amino acid residues may be present in, and/or may be corporated into, an amino acid sequence of the invention, in particular in such a way that they form (part of) the antigen binding site of an amino acid sequence of the invention. As these stretches of amino acid residues were first generated as CDR sequences of heavy chain antibodies or $V_{HH}$ sequences that were raised against an envelope protein of a virus (or may be based on and/or derived from such CDR sequences, as further described herein), they will also generally be referred to herein as "CDR sequences" (i.e. as CDR1 sequences, CDR2 sequences and CDR3 sequences, respectively). It should however be noted that the invention in its broadest sense is not limited to a specific structural role or function that these stretches of amino acid residues may have in an amino acid sequence of the invention, as long as these stretches of amino acid residues allow the amino acid sequence of the invention to bind to an envelope protein of a virus. Thus, generally, the invention in its broadest sense comprises any amino acid sequence that is capable of binding to an envelope protein of a virus and that comprises one or more CDR sequences as described herein, and in particular a suitable combination of two or more such CDR sequences, that are suitably linked to each other via one or more further amino acid sequences, such that the entire amino acid sequence forms a binding domain and/or binding unit that is capable of binding to an envelope protein of a virus. It should however also be noted that the presence of only one such CDR sequence in an amino acid sequence of the invention may by itself already be sufficient to provide an amino acid sequence of the invention that is capable of binding to an envelope protein of a virus; reference is for example again made to the so-called "Expedite fragments" described in WO 03/050531.

Thus, in another specific, but non-limiting aspect, the amino acid sequence of the invention may be an amino acid sequence that comprises at least one amino acid sequence that is chosen from the group consisting of the CDR1 sequences, CDR2 sequences and CDR3 sequences that are described herein (or any suitable combination thereof). In particular, an amino acid sequence of the invention may be an amino acid sequence that comprises at least one antigen binding site, wherein said antigen binding site comprises at least one amino acid sequence that is chosen from the group consisting of the CDR1 sequences, CDR2 sequences and CDR3 sequences that are described herein (or any suitable combination thereof).

Generally, in this aspect of the invention, the amino acid sequence of the invention may be any amino acid sequence that comprises at least one stretch of amino acid residues, in which said stretch of amino acid residues has an amino acid sequence that corresponds to the sequence of at least one of the CDR sequences described herein. Such an amino acid sequence may or may not comprise an immunoglobulin fold. For example, and without limitation, such an amino acid sequence may be a suitable fragment of an immunoglobulin sequence that comprises at least one such CDR sequence, but that is not large enough to form a (complete) immunoglobulin fold (reference is for example again made to the "Expedite fragments" described in WO 03/050531). Alternatively, such an amino acid sequence may be a suitable "protein scaffold" that comprises least one stretch of amino acid residues that corresponds to such a CDR sequence (i.e. as part of its antigen binding site). Suitable scaffolds for presenting amino acid sequences will be clear to the skilled person, and for example comprise, without limitation, to binding scaffolds based on or derived from immunoglobulins (i.e. other than the immunoglobulin sequences already described herein), protein scaffolds derived from protein A domains (such as Affibodies™), tendamistat, fibronectin, lipocalin, CTLA-4, T-cell receptors, designed ankyrin repeats, avimers and PDZ domains (Binz et al., Nat. Biotech 2005, Vol 23:1257), and binding moieties based on DNA or RNA including but not limited to DNA or RNA aptamers (Ulrich et al., Comb. Chem. High Throughput Screen 2006 9(8): 619-32).

Again, any amino acid sequence of the invention that comprises one or more of these CDR sequences is preferably such that it can specifically bind (as defined herein) to an envelope protein of a virus, and more in particular such that it can bind to an envelope protein of a virus with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein), that is as defined herein.

More in particular, the amino acid sequences according to this aspect of the invention may be any amino acid sequence that comprises at least one antigen binding site, wherein said antigen binding site comprises at least two amino acid sequences that are chosen from the group consisting of the CDR1 sequences described herein, the CDR2 sequences described herein and the CDR3 sequences described herein, such that (i) when the first amino acid sequence is chosen from the CDR1 sequences described herein, the second amino acid sequence is chosen from the CDR2 sequences described herein or the CDR3 sequences described herein; (ii) when the first amino acid sequence is chosen from the CDR2 sequences described herein, the second amino acid sequence is chosen from the CDR1 sequences described herein or the CDR3 sequences described herein; or (iii) when the first amino acid sequence is chosen from the CDR3 sequences described herein, the second amino acid sequence is chosen from the CDR1 sequences described herein or the CDR3 sequences described herein.

Even more in particular, the amino acid sequences of the invention may be amino acid sequences that comprise at least one antigen binding site, wherein said antigen binding site comprises at least three amino acid sequences that are chosen from the group consisting of the CDR1 sequences described herein, the CDR2 sequences described herein and the CDR3 sequences described herein, such that the first amino acid sequence is chosen from the CDR1 sequences described herein, the second amino acid sequence is chosen from the CDR2 sequences described herein, and the third amino acid sequence is chosen from the CDR3 sequences described herein. Preferred combinations of CDR1, CDR2 and CDR3 sequences will become clear from the further description herein. As will be clear to the skilled person, such an amino acid sequence is preferably an immunoglobulin sequence (as further described herein), but it may for example also be any other amino acid sequence that comprises a suitable scaffold for presenting said CDR sequences.

Thus, in one specific, but non-limiting aspect, the invention relates to an amino acid sequence directed against an envelope protein of a virus, that comprises one or more stretches of amino acid residues chosen from the group consisting of:

a) the amino acid sequences of SEQ ID NO's: 690 to 971, 2467 to 2484, 2590 to 2597, 2754 to 2789 and 3194 to 3258;
b) amino acid sequences that have at least 80% amino acid identity with at least one of the amino acid sequences of SEQ ID NO's: 690 to 971, 2467 to 2484, 2590 to 2597, 2754 to 2789 and 3194 to 3258;
c) amino acid sequences that have 3, 2, or 1 amino acid difference with at least one of the amino acid sequences of SEQ ID NO's: 690 to 971, 2467 to 2484, 2590 to 2597, 2754 to 2789 and 3194 to 3258;
d) the amino acid sequences of SEQ ID NO's: 1254 to 1535, 2503 to 2520, 2606 to 2613, 2826 to 2861 and 3324 to 3388;
e) amino acid sequences that have at least 80% amino acid identity with at least one of the amino acid sequences of SEQ ID NO's: 1254 to 1535, 2503 to 2520, 2606 to 2613, 2826 to 2861 and 3324 to 3388;
f) amino acid sequences that have 3, 2, or 1 amino acid difference with at least one of the amino acid sequences of SEQ ID NO's: 1254 to 1535, 2503 to 2520, 2606 to 2613, 2826 to 2861 and 3324 to 3388;
g) the amino acid sequences of SEQ ID NO's: 1818 to 2099, 2539 to 2556, 2622 to 2629, 2898 to 2933 and 3454 to 3518;
h) amino acid sequences that have at least 80% amino acid identity with at least one of the amino acid sequences of SEQ ID NO's: 1818 to 2099, 2539 to 2556, 2622 to 2629, 2898 to 2933 and 3454 to 3518;
i) amino acid sequences that have 3, 2, or 1 amino acid difference with at least one of the amino acid sequences of SEQ ID NO's: 1818 to 2099, 2539 to 2556, 2622 to 2629, 2898 to 2933 and 3454 to 3518;

or any suitable combination thereof.

When an amino acid sequence of the invention contains one or more amino acid sequences according to b) and/or c):

i) any amino acid substitution in such an amino acid sequence according to b) and/or c) is preferably, and compared to the corresponding amino acid sequence according to a), a conservative amino acid substitution, (as defined herein);

and/or ii) the amino acid sequence according to b) and/or c) preferably only contains amino acid substitutions, and no amino acid deletions or insertions, compared to the corresponding amino acid sequence according to a);

and/or iii) the amino acid sequence according to b) and/or c) may be an amino acid sequence that is derived from an amino acid sequence according to a) by means of affinity maturation using one or more techniques of affinity maturation known per se.

Similarly, when an amino acid sequence of the invention contains one or more amino acid sequences according to e) and/or f):

i) any amino acid substitution in such an amino acid sequence according to e) and/or f) is preferably, and compared to the corresponding amino acid sequence according to d), a conservative amino acid substitution, (as defined herein);

and/or ii) the amino acid sequence according to e) and/or f) preferably only contains amino acid substitutions, and no amino acid deletions or insertions, compared to the corresponding amino acid sequence according to d);

and/or iii) the amino acid sequence according to e) and/or f) may be an amino acid sequence that is derived from an amino acid sequence according to d) by means of affinity maturation using one or more techniques of affinity maturation known per se.

Also, similarly, when an amino acid sequence of the invention contains one or more amino acid sequences according to h) and/or i):

i) any amino acid substitution in such an amino acid sequence according to h) and/or i) is preferably, and compared to the corresponding amino acid sequence according to g), a conservative amino acid substitution, (as defined herein);

and/or ii) the amino acid sequence according to h) and/or i) preferably only contains amino acid substitutions, and no amino acid deletions or insertions, compared to the corresponding amino acid sequence according to g);

and/or iii) the amino acid sequence according to h) and/or i) may be an amino acid sequence that is derived from an amino acid sequence according to g) by means of affinity maturation using one or more techniques of affinity maturation known per se.

It should be understood that the last preceding paragraphs also generally apply to any amino acid sequences of the invention that comprise one or more amino acid sequences according to b), c), e), f), h) or i), respectively.

In this specific aspect, the amino acid sequence preferably comprises one or more stretches of amino acid residues chosen from the group consisting of:

i) the amino acid sequences of SEQ ID NO's: 690 to 971, 2467 to 2484, 2590 to 2597, 2754 to 2789 and 3194 to 3258;

ii) the amino acid sequences of SEQ ID NO's: 1254 to 1535, 2503 to 2520, 2606 to 2613, 2826 to 2861 and 3324 to 3388; and iii) the amino acid sequences of SEQ ID NO's: 1818 to 2099, 2539 to 2556, 2622 to 2629, 2898 to 2933 and 3454 to 3518;

or any suitable combination thereof.

Also, preferably, in such an amino acid sequence, at least one of said stretches of amino acid residues forms part of the antigen binding site for binding against an envelope protein of a virus.

In a more specific, but again non-limiting aspect, the invention relates to an amino acid sequence directed against an envelope protein of a virus, that comprises two or more stretches of amino acid residues chosen from the group consisting of:

a) the amino acid sequences of SEQ ID NO's: 690 to 971, 2467 to 2484, 2590 to 2597, 2754 to 2789 and 3194 to 3258;

b) amino acid sequences that have at least 80% amino acid identity with at least one of the amino acid sequences of SEQ ID NO's: 690 to 971, 2467 to 2484, 2590 to 2597, 2754 to 2789 and 3194 to 3258;

c) amino acid sequences that have 3, 2, or 1 amino acid difference with at least one of the amino acid sequences of SEQ ID NO's: 690 to 971, 2467 to 2484, 2590 to 2597, 2754 to 2789 and 3194 to 3258;

d) the amino acid sequences of SEQ ID NO's: 1254 to 1535, 2503 to 2520, 2606 to 2613, 2826 to 2861 and 3324 to 3388;

e) amino acid sequences that have at least 80% amino acid identity with at least one of the amino acid sequences of SEQ ID NO's: 1254 to 1535, 2503 to 2520, 2606 to 2613, 2826 to 2861 and 3324 to 3388;

f) amino acid sequences that have 3, 2, or 1 amino acid difference with at least one of the amino acid sequences of SEQ ID NO's: 1254 to 1535, 2503 to 2520, 2606 to 2613, 2826 to 2861 and 3324 to 3388;

g) the amino acid sequences of SEQ ID NO's: 1818 to 2099, 2539 to 2556, 2622 to 2629, 2898 to 2933 and 3454 to 3518;

h) amino acid sequences that have at least 80% amino acid identity with at least one of the amino acid sequences of SEQ ID NO's: 1818 to 2099, 2539 to 2556, 2622 to 2629, 2898 to 2933 and 3454 to 3518;

i) amino acid sequences that have 3, 2, or 1 amino acid difference with at least one of the amino acid sequences of SEQ ID NO's: 1818 to 2099, 2539 to 2556, 2622 to 2629, 2898 to 2933 and 3454 to 3518;

such that (i) when the first stretch of amino acid residues corresponds to one of the amino acid sequences according to a), b) or c), the second stretch of amino acid residues corresponds to one of the amino acid sequences according to d), e), f), g), h) or i); (ii) when the first stretch of amino acid residues corresponds to one of the amino acid sequences according to d), e) or f), the second stretch of amino acid residues corresponds to one of the amino acid sequences according to a), b), c), g), h) or i); or (iii) when the first stretch of amino acid residues corresponds to one of the amino acid sequences according to g), h) or i), the second stretch of amino acid residues corresponds to one of the amino acid sequences according to a), b), c), d), e) or f).

In this specific aspect, the amino acid sequence preferably comprises two or more stretches of amino acid residues chosen from the group consisting of:

i) the amino acid sequences of SEQ ID NO's: 690 to 971, 2467 to 2484, 2590 to 2597, 2754 to 2789 and 3194 to 3258;

ii) the amino acid sequences of SEQ ID NO's: 1254 to 1535, 2503 to 2520, 2606 to 2613, 2826 to 2861 and 3324 to 3388; and iii) the amino acid sequences of SEQ ID NO's: 1818 to 2099, 2539 to 2556, 2622 to 2629, 2898 to 2933 and 3454 to 3518;

such that, (i) when the first stretch of amino acid residues corresponds to one of the amino acid sequences of SEQ ID NO's: 690 to 971, 2467 to 2484, 2590 to 2597, 2754 to 2789 and 3194 to 3258, the second stretch of amino acid residues corresponds to one of the amino acid sequences of SEQ ID NO's: 1254 to 1535, 2503 to 2520, 2606 to 2613, 2826 to 2861 and 3324 to 3388, or of SEQ ID NO's: 1818 to 2099, 2539 to 2556, 2622 to 2629, 2898 to 2933 and 3454 to 3518; (ii) when the first stretch of amino acid residues corresponds to one of the amino acid sequences of SEQ ID NO's: 1254 to 1535, 2503 to 2520, 2606 to 2613, 2826 to 2861 and 3324 to 3388, the second stretch of amino acid residues corresponds to one of the amino acid sequences of SEQ ID NO's: 690 to 971, 2467 to 2484, 2590 to 2597, 2754 to 2789 and 3194 to 3258 or of SEQ ID NO's: 1818 to 2099, 2539 to 2556, 2622 to 2629, 2898 to 2933 and 3454 to 3518; or (iii) when the first stretch of amino acid residues corresponds to one of the amino acid sequences of SEQ ID NO's: 1818 to 2099, 2539 to 2556, 2622 to 2629, 2898 to 2933 and 3454 to 3518, the second stretch of amino acid residues corresponds to one of the amino acid sequences of SEQ ID NO's: 690 to 971, 2467 to 2484, 2590 to 2597, 2754 to 2789 and 3194 to 3258 or of SEQ ID NO's: 1254 to 1535, 2503 to 2520, 2606 to 2613, 2826 to 2861 and 3324 to 3388.

Also, in such an amino acid sequence, the at least two stretches of amino acid residues again preferably form part of the antigen binding site for binding to an envelope protein of a virus.

In an even more specific, but non-limiting aspect, the invention relates to an amino acid sequence directed against an envelope protein of a virus, that comprises three or more stretches of amino acid residues, in which the first stretch of amino acid residues is chosen from the group consisting of:

a) the amino acid sequences of SEQ ID NO's: 690 to 971, 2467 to 2484, 2590 to 2597, 2754 to 2789 and 3194 to 3258;

b) amino acid sequences that have at least 80% amino acid identity with at least one of the amino acid sequences of SEQ ID NO's: 690 to 971, 2467 to 2484, 2590 to 2597, 2754 to 2789 and 3194 to 3258;

c) amino acid sequences that have 3, 2, or 1 amino acid difference with at least one of the amino acid sequences of SEQ ID NO's: 690 to 971, 2467 to 2484, 2590 to 2597, 2754 to 2789 and 3194 to 3258;

the second stretch of amino acid residues is chosen from the group consisting of:

d) the amino acid sequences of SEQ ID NO's: 1254 to 1535, 2503 to 2520, 2606 to 2613, 2826 to 2861 and 3324 to 3388;

e) amino acid sequences that have at least 80% amino acid identity with at least one of the amino acid sequences of SEQ ID NO's: 1254 to 1535, 2503 to 2520, 2606 to 2613, 2826 to 2861 and 3324 to 3388;

f) amino acid sequences that have 3, 2, or 1 amino acid difference with at least one of the amino acid sequences of SEQ ID NO's: 1254 to 1535, 2503 to 2520, 2606 to 2613, 2826 to 2861 and 3324 to 3388;

and the third stretch of amino acid residues is chosen from the group consisting of:

g) the amino acid sequences of SEQ ID NO's: 1818 to 2099, 2539 to 2556, 2622 to 2629, 2898 to 2933 and 3454 to 3518;

h) amino acid sequences that have at least 80% amino acid identity with at least one of the amino acid sequences of SEQ ID NO's: 1818 to 2099, 2539 to 2556, 2622 to 2629, 2898 to 2933 and 3454 to 3518;

i) amino acid sequences that have 3, 2, or 1 amino acid difference with at least one of the amino acid sequences of SEQ ID NO's: 1818 to 2099, 2539 to 2556, 2622 to 2629, 2898 to 2933 and 3454 to 3518.

Preferably, in this specific aspect, the first stretch of amino acid residues is chosen from the group consisting of the amino acid sequences of SEQ ID NO's: 690 to 971, 2467 to 2484, 2590 to 2597, 2754 to 2789 and 3194 to 3258; the second stretch of amino acid residues is chosen from the group consisting of the amino acid sequences of SEQ ID NO's: 1254 to 1535, 2503 to 2520, 2606 to 2613, 2826 to 2861 and 3324 to 3388; and the third stretch of amino acid residues is chosen from the group consisting of the amino acid sequences of SEQ ID NO's: 1818 to 2099, 2539 to 2556, 2622 to 2629, 2898 to 2933 and 3454 to 3518.

Again, preferably, in such an amino acid sequence, the at least three stretches of amino acid residues forms part of the antigen binding site for binding to an envelope protein of a virus.

Preferred combinations of such stretches of amino acid sequences will become clear from the further disclosure herein.

Preferably, in such amino acid sequences the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 126 to 407, 2431 to 2448, 2574 to 2581, 2682 to 2717 and 3064 to 3128 (see Table A-1). This degree of amino acid identity can for example be determined by determining the degree of amino acid identity (in a manner described herein) between said amino acid sequence and one or more of the sequences of SEQ ID NO's: 126 to 407, 2431 to 2448, 2574 to 2581, 2682 to 2717 and 3064 to 3128 (see Table A-1), in which the amino acid residues that form the framework regions are disregarded. Also, such amino acid sequences of the invention can be as further described herein.

Also, such amino acid sequences are preferably such that they can specifically bind (as defined herein) to an envelope protein of a virus; and more in particular bind to an envelope protein of a virus with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

When the amino acid sequence of the invention essentially consists of 4 framework regions (FR1 to FR4, respectively) and 3 complementarity determining regions (CDR1 to CDR3, respectively), the amino acid sequence of the invention is preferably such that:

CDR1 is chosen from the group consisting of:

a) the amino acid sequences of SEQ ID NO's: 690 to 971, 2467 to 2484, 2590 to 2597, 2754 to 2789 and 3194 to 3258;

b) amino acid sequences that have at least 80% amino acid identity with at least one of the amino acid sequences of SEQ ID NO's: 690 to 971, 2467 to 2484, 2590 to 2597, 2754 to 2789 and 3194 to 3258;

c) amino acid sequences that have 3, 2, or 1 amino acid difference with at least one of the amino acid sequences of SEQ ID NO's: 690 to 971, 2467 to 2484, 2590 to 2597, 2754 to 2789 and 3194 to 3258;

and/or

CDR2 is chosen from the group consisting of:

d) the amino acid sequences of SEQ ID NO's: 1254 to 1535, 2503 to 2520, 2606 to 2613, 2826 to 2861 and 3324 to 3388;

e) amino acid sequences that have at least 80% amino acid identity with at least one of the amino acid sequences of SEQ ID NO's: 1254 to 1535, 2503 to 2520, 2606 to 2613, 2826 to 2861 and 3324 to 3388;

f) amino acid sequences that have 3, 2, or 1 amino acid difference with at least one of the amino acid sequences of SEQ ID NO's: 1254 to 1535, 2503 to 2520, 2606 to 2613, 2826 to 2861 and 3324 to 3388;

and/or

CDR3 is chosen from the group consisting of:

g) the amino acid sequences of SEQ ID NO's: 1818 to 2099, 2539 to 2556, 2622 to 2629, 2898 to 2933 and 3454 to 3518;

h) amino acid sequences that have at least 80% amino acid identity with at least one of the amino acid sequences of SEQ ID NO's: 1818 to 2099, 2539 to 2556, 2622 to 2629, 2898 to 2933 and 3454 to 3518;

i) amino acid sequences that have 3, 2, or 1 amino acid difference with at least one of the amino acid sequences of SEQ ID NO's: 1818 to 2099, 2539 to 2556, 2622 to 2629, 2898 to 2933 and 3454 to 3518.

In particular, such an amino acid sequence of the invention may be such that CDR1 is chosen from the group consisting of the amino acid sequences of SEQ ID NO's: 690 to 971, 2467 to 2484, 2590 to 2597, 2754 to 2789 and 3194 to 3258; and/or CDR2 is chosen from the group consisting of the amino acid sequences of SEQ ID NO's: 1254 to 1535, 2503 to 2520, 2606 to 2613, 2826 to 2861 and 3324 to 3388; and/or CDR3 is chosen from the group consisting of the amino acid sequences of SEQ ID NO's: 1818 to 2099, 2539 to 2556, 2622 to 2629, 2898 to 2933 and 3454 to 3518.

In particular, when the amino acid sequence of the invention essentially consists of 4 framework regions (FR1 to FR4, respectively) and 3 complementarity determining regions (CDR1 to CDR3, respectively), the amino acid sequence of the invention is preferably such that:

CDR1 is chosen from the group consisting of:

a) the amino acid sequences of SEQ ID NO's: 690 to 971, 2467 to 2484, 2590 to 2597, 2754 to 2789 and 3194 to 3258;

b) amino acid sequences that have at least 80% amino acid identity with at least one of the amino acid sequences of SEQ ID NO's: 690 to 971, 2467 to 2484, 2590 to 2597, 2754 to 2789 and 3194 to 3258;

c) amino acid sequences that have 3, 2, or 1 amino acid difference with at least one of the amino acid sequences of SEQ ID NO's: 690 to 971, 2467 to 2484, 2590 to 2597, 2754 to 2789 and 3194 to 3258;

and

CDR2 is chosen from the group consisting of:

d) the amino acid sequences of SEQ ID NO's: 1254 to 1535, 2503 to 2520, 2606 to 2613, 2826 to 2861 and 3324 to 3388;

e) amino acid sequences that have at least 80% amino acid identity with at least one of the amino acid sequences of SEQ ID NO's: 1254 to 1535, 2503 to 2520, 2606 to 2613, 2826 to 2861 and 3324 to 3388;

f) amino acid sequences that have 3, 2, or 1 amino acid difference with at least one of the amino acid sequences of SEQ ID NO's: 1254 to 1535, 2503 to 2520, 2606 to 2613, 2826 to 2861 and 3324 to 3388;

and

CDR3 is chosen from the group consisting of:

g) the amino acid sequences of SEQ ID NO's: 1818 to 2099, 2539 to 2556, 2622 to 2629, 2898 to 2933 and 3454 to 3518;

h) amino acid sequences that have at least 80% amino acid identity with at least one of the amino acid sequences of SEQ ID NO's: 1818 to 2099, 2539 to 2556, 2622 to 2629, 2898 to 2933 and 3454 to 3518;

i) amino acid sequences that have 3, 2, or 1 amino acid difference with at least one of the amino acid sequences of SEQ ID NO's: 1818 to 2099, 2539 to 2556, 2622 to 2629, 2898 to 2933 and 3454 to 3518; or any suitable fragment of such an amino acid sequence In particular, such an amino acid sequence of the invention may be such that CDR1 is chosen from the group consisting of the amino acid sequences of SEQ ID NO's: 690 to 971, 2467 to 2484, 2590 to 2597, 2754 to 2789 and 3194 to 3258; and CDR2 is chosen from the group consisting of the amino acid sequences of SEQ ID NO's: 1254 to 1535, 2503 to 2520, 2606 to 2613, 2826 to 2861 and 3324 to 3388; and CDR3 is chosen from the group consisting of the amino acid sequences of SEQ ID NO's: 1818 to 2099, 2539 to 2556, 2622 to 2629, 2898 to 2933 and 3454 to 3518.

Again, preferred combinations of CDR sequences will become clear from the further description herein.

Also, such amino acid sequences are preferably such that they can specifically bind (as defined herein) to an envelope protein of a virus; and more in particular bind to an envelope protein of a virus with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

In one preferred, but non-limiting aspect, the invention relates to an amino acid sequence that essentially consists of 4 framework regions (FR1 to FR4, respectively) and 3 complementarity determining regions (CDR1 to CDR3, respectively), in which the CDR sequences of said amino acid sequence have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 126 to 407, 2431 to 2448, 2574 to 2581, 2682 to 2717 and 3064 to 3128. This degree of amino acid identity can for example be determined by determining the degree of amino acid identity (in a manner described herein) between said amino acid sequence and one or more of the sequences of SEQ ID NO's: 126 to 407, 2431 to 2448, 2574 to 2581, 2682 to 2717 and 3064 to 3128, in which the amino acid residues that form the framework regions are disregarded. Such amino acid sequences of the invention can be as further described herein.

In a more specific, but again non-limiting aspect, the invention relates to an amino acid sequence directed against at least one epitope of the F-protein of human RSV virus, that comprises one or more stretches of amino acid residues chosen from the group consisting of:

a) the amino acid sequences of SEQ ID NO's: 722 to 800, 812 to 971, 2484 and 2590 to 2597;

b) amino acid sequences that have at least 80% amino acid identity with at least one of the amino acid sequences of SEQ ID NO's: 722 to 800, 812 to 971, 2484 and 2590 to 2597;

c) amino acid sequences that have 3, 2, or 1 amino acid difference with at least one of the amino acid sequences of SEQ ID NO's: 722 to 800, 812 to 971, 2484 and 2590 to 2597;

d) the amino acid sequences of SEQ ID NO's: 1286 to 1364, 1376 to 1535, 2520 and 2606 to 2613;

e) amino acid sequences that have at least 80% amino acid identity with at least one of the amino acid sequences of SEQ ID NO's: 1286 to 1364, 1376 to 1535, 2520 and 2606 to 2613;

f) amino acid sequences that have 3, 2, or 1 amino acid difference with at least one of the amino acid sequences of SEQ ID NO's: 1286 to 1364, 1376 to 1535, 2520 and 2606 to 2613;

g) the amino acid sequences of SEQ ID NO's: 1850 to 1928, 1940 to 2099, 2556 and 2622 to 2629;

h) amino acid sequences that have at least 80% amino acid identity with at least one of the amino acid sequences of SEQ ID NO's: 1850 to 1928, 1940 to 2099, 2556 and 2622 to 2629;

i) amino acid sequences that have 3, 2, or 1 amino acid difference with at least one of the amino acid sequences of SEQ ID NO's: 1850 to 1928, 1940 to 2099, 2556 and 2622 to 2629;

or any suitable combination thereof.

When an amino acid sequence of the invention contains one or more amino acid sequences according to b) and/or c):

i) any amino acid substitution in such an amino acid sequence according to b) and/or c) is preferably, and compared to the corresponding amino acid sequence according to a), a conservative amino acid substitution, (as defined herein);

and/or ii) the amino acid sequence according to b) and/or c) preferably only contains amino acid substitutions, and no amino acid deletions or insertions, compared to the corresponding amino acid sequence according to a);

and/or iii) the amino acid sequence according to b) and/or c) may be an amino acid sequence that is derived from an amino acid sequence according to a) by means of affinity maturation using one or more techniques of affinity maturation known per se.

Similarly, when an amino acid sequence of the invention contains one or more amino acid sequences according to e) and/or f):

i) any amino acid substitution in such an amino acid sequence according to e) and/or f) is preferably, and compared to the corresponding amino acid sequence according to d), a conservative amino acid substitution, (as defined herein);

and/or ii) the amino acid sequence according to e) and/or f) preferably only contains amino acid substitutions, and no amino acid deletions or insertions, compared to the corresponding amino acid sequence according to d);

and/or iii) the amino acid sequence according to e) and/or f) may be an amino acid sequence that is derived from an amino acid sequence according to d) by means of affinity maturation using one or more techniques of affinity maturation known per se.

Also, similarly, when an amino acid sequence of the invention contains one or more amino acid sequences according to h) and/or i):

i) any amino acid substitution in such an amino acid sequence according to h) and/or i) is preferably, and compared to the corresponding amino acid sequence according to g), a conservative amino acid substitution, (as defined herein);

and/or ii) the amino acid sequence according to h) and/or i) preferably only contains amino acid substitutions, and no amino acid deletions or insertions, compared to the corresponding amino acid sequence according to g);

and/or iii) the amino acid sequence according to h) and/or i) may be an amino acid sequence that is derived from an amino acid sequence according to g) by means of affinity maturation using one or more techniques of affinity maturation known per se.

It should be understood that the last preceding paragraphs also generally apply to any amino acid sequences of the invention that comprise one or more amino acid sequences according to b), c), e), f), h) or i), respectively.

In this specific aspect, the amino acid sequence preferably comprises one or more stretches of amino acid residues chosen from the group consisting of:

i) the amino acid sequences of SEQ ID NO's: 722 to 800, 812 to 971, 2484 and 2590 to 2597;

ii) the amino acid sequences of SEQ ID NO's: 1286 to 1364, 1376 to 1535, 2520 and 2606 to 2613; and iii) the amino acid sequences of SEQ ID NO's: 1850 to 1928, 1940 to 2099, 2556 and 2622 to 2629;

or any suitable combination thereof.

Also, preferably, in such an amino acid sequence, at least one of said stretches of amino acid residues forms part of the antigen binding site for binding the F-protein of human RSV virus.

In a more specific, but again non-limiting aspect, the invention relates to an amino acid sequence directed against at least one epitope of the F-protein of human RSV virus, that comprises two or more stretches of amino acid residues chosen from the group consisting of:

a) the amino acid sequences of SEQ ID NO's: 722 to 800, 812 to 971, 2484 and 2590 to 2597;

b) amino acid sequences that have at least 80% amino acid identity with at least one of the amino acid sequences of SEQ ID NO's: 722 to 800, 812 to 971, 2484 and 2590 to 2597;

c) amino acid sequences that have 3, 2, or 1 amino acid difference with at least one of the amino acid sequences of SEQ ID NO's: 722 to 800, 812 to 971. 2484 and 2590 to 2597;

d) the amino acid sequences of SEQ ID NO's: 1286 to 1364, 1376 to 1535, 2520 and 2606 to 2613;

e) amino acid sequences that have at least 80% amino acid identity with at least one of the amino acid sequences of SEQ ID NO's: 1286 to 1364, 1376 to 1535, 2520 and 2606 to 2613;

f) amino acid sequences that have 3, 2, or 1 amino acid difference with at least one of the amino acid sequences of SEQ ID NO's: 1286 to 1364, 1376 to 1535, 2520 and 2606 to 2613;

g) the amino acid sequences of SEQ ID NO's: 1850 to 1928, 1940 to 2099, 2556 and 2622 to 2629;

h) amino acid sequences that have at least 80% amino acid identity with at least one of the amino acid sequences of SEQ ID NO's: 1850 to 1928, 1940 to 2099, 2556 and 2622 to 2629;

i) amino acid sequences that have 3, 2, or 1 amino acid difference with at least one of the amino acid sequences of SEQ ID NO's: 1850 to 1928, 1940 to 2099, 2556 and 2622 to 2629;

such that (i) when the first stretch of amino acid residues corresponds to one of the amino acid sequences according to a), b) or c), the second stretch of amino acid residues corresponds to one of the amino acid sequences according to d), e), f), g), h) or i); (ii) when the first stretch of amino acid residues corresponds to one of the amino acid sequences according to d), e) or f), the second stretch of amino acid residues corresponds to one of the amino acid sequences according to a), b), c), g), h) or i); or (iii) when the first stretch of amino acid residues corresponds to one of the amino acid sequences according to g), h) or i), the second stretch of amino acid residues corresponds to one of the amino acid sequences according to a), b), c), d), e) or f).

In this specific aspect, the amino acid sequence preferably comprises two or more stretches of amino acid residues chosen from the group consisting of:

i) the amino acid sequences of SEQ ID NO's: 722 to 800, 812 to 971, 2484 and 2590 to 2597;

ii) the amino acid sequences of SEQ ID NO's: 1286 to 1364, 1376 to 1535, 2520 and 2606 to 2613; and iii) the amino acid sequences of SEQ ID NO's: 1850 to 1928, 1940 to 2099, 2556 and 2622 to 2629;

such that, (i) when the first stretch of amino acid residues corresponds to one of the amino acid sequences of SEQ ID NO's: 722 to 800, 812 to 971, 2484 and 2590 to 2597, the second stretch of amino acid residues corresponds to one of the amino acid sequences of SEQ ID NO's: 1286 to 1364, 1376 to 1535, 2520 and 2606 to 2613 or of SEQ ID NO's: 1850 to 1928, 1940 to 2099, 2556 and 2622 to 2629; (ii) when the first stretch of amino acid residues corresponds to one of the amino acid sequences of SEQ ID NO's: 1286 to 1364, 1376 to 1535, 2520 and 2606 to 2613, the second stretch of amino acid residues corresponds to one of the amino acid sequences of SEQ ID NO's: 722 to 800, 812 to 971, 2484 and 2590 to 2597 or of SEQ ID NO's: 1850 to 1928, 1940 to 2099, 2556 and 2622 to 2629; or (iii) when the first stretch of amino acid residues corresponds to one of the amino acid sequences of SEQ ID NO's: 1850 to 1928, 1940 to 2099, 2556, and 2622 to 2629, the second stretch of amino acid residues corresponds to one of the amino acid sequences of SEQ ID NO's: 722 to 800, 812 to 971, 2484, and 2590 to 2597 or of SEQ ID NO's: 1286 to 1364, 1376 to 1535, 2520 and 2606 to 2613.

Also, in such an amino acid sequence, the at least two stretches of amino acid residues again preferably form part of the antigen binding site for binding to the F-protein of human RSV virus.

In an even more specific, but non-limiting aspect, the invention relates to an amino acid sequence directed against the F-protein of human RSV virus, that comprises three or more stretches of amino acid residues, in which the first stretch of amino acid residues is chosen from the group consisting of:

a) the amino acid sequences of SEQ ID NO's: 722 to 800, 812 to 971, 2484 and 2590 to 2597;
b) amino acid sequences that have at least 80% amino acid identity with at least one of the amino acid sequences of SEQ ID NO's: 722 to 800, 812 to 971, 2484 and 2590 to 2597;
c) amino acid sequences that have 3, 2, or 1 amino acid difference with at least one of the amino acid sequences of SEQ ID NO's: 722 to 800, 812 to 971, 2484 and 2590 to 2597 the second stretch of amino acid residues is chosen from the group consisting of:

d) the amino acid sequences of SEQ ID NO's: 1286 to 1364, 1376 to 1535, 2520 and 2606 to 2613;
e) amino acid sequences that have at least 80% amino acid identity with at least one of the amino acid sequences of SEQ ID NO's: 1286 to 1364, 1376 to 1535, 2520 and 2606 to 2613;
f) amino acid sequences that have 3, 2, or 1 amino acid difference with at least one of the amino acid sequences of SEQ ID NO's: 1286 to 1364, 1376 to 1535, 2520 and 2606 to 2613;

and the third stretch of amino acid residues is chosen from the group consisting of:

g) the amino acid sequences of SEQ ID NO's: 1850 to 1928, 1940 to 2099, 2556 and 2622 to 2629;
h) amino acid sequences that have at least 80% amino acid identity with at least one of the amino acid sequences of SEQ ID NO's: 1850 to 1928, 1940 to 2099, 2556 and 2622 to 2629;
i) amino acid sequences that have 3, 2, or 1 amino acid difference with at least one of the amino acid sequences of SEQ ID NO's: 1850 to 1928, 1940 to 2099, 2556 and 2622 to 2629.

Preferably, in this specific aspect, the first stretch of amino acid residues is chosen from the group consisting of the amino acid sequences of SEQ ID NO's: 722 to 800, 812 to 971, 2484 and 2590 to 2597; the second stretch of amino acid residues is chosen from the group consisting of the amino acid sequences of SEQ ID NO's: 1286 to 1364, 1376 to 1535, 2520 and 2606 to 2613; and the third stretch of amino acid residues is chosen from the group consisting of the amino acid sequences of SEQ ID NO's: 1850 to 1928, 1940 to 2099, 2556 and 2622 to 2629.

Again, preferably, in such an amino acid sequence, the at least three stretches of amino acid residues form part of the antigen binding site for binding to the F-protein of human RSV virus.

Preferred combinations of such stretches of amino acid sequences will become clear from the further disclosure herein.

Preferably, in such amino acid sequences the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 158 to 236, 248 to 407, 2448 and 2574 to 2581 (see Table A-1). This degree of amino acid identity can for example be determined by determining the degree of amino acid identity (in a manner described herein) between said amino acid sequence and one or more of the sequences of SEQ ID NO's: 158 to 236, 248 to 407, 2448, and 2574 to 2581 (see Table A-1), in which the amino acid residues that form the framework regions are disregarded. Also, such amino acid sequences of the invention can be as further described herein.

Also, such amino acid sequences are preferably such that they can specifically bind (as defined herein) to the F-protein of human RSV virus; and more in particular bind to the F-protein of human RSV virus with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

When the amino acid sequence of the invention essentially consists of 4 framework regions (FR1 to FR4, respectively) and 3 complementarity determining regions (CDR1 to CDR3, respectively), the amino acid sequence of the invention is preferably such that:

CDR1 is chosen from the group consisting of:

a) the amino acid sequences of SEQ ID NO's: 722 to 800, 812 to 971, 2484 and 2590 to 2597;
b) amino acid sequences that have at least 80% amino acid identity with at least one of the amino acid sequences of SEQ ID NO's: 722 to 800, 812 to 971, 2484 and 2590 to 2597;
c) amino acid sequences that have 3, 2, or 1 amino acid difference with at least one of the amino acid sequences of SEQ ID NO's: 722 to 800, 812 to 971, 2484 and 2590 to 2597;

and/or

CDR2 is chosen from the group consisting of:

d) the amino acid sequences of SEQ ID NO's: 1286 to 1364, 1376 to 1535, 2520 and 2606 to 2613;
e) amino acid sequences that have at least 80% amino acid identity with at least one of the amino acid sequences of SEQ ID NO's: 1286 to 1364, 1376 to 1535, 2520 and 2606 to 2613;
f) amino acid sequences that have 3, 2, or 1 amino acid difference with at least one of the amino acid sequences of SEQ ID NO's: 1286 to 1364, 1376 to 1535, 2520 and 2606 to 2613;

and/or

CDR3 is chosen from the group consisting of:

g) the amino acid sequences of SEQ ID NO's: 1850 to 1928, 1940 to 2099, 2556 and 2622 to 2629;
h) amino acid sequences that have at least 80% amino acid identity with at least one of the amino acid sequences of SEQ ID NO's: 1850 to 1928, 1940 to 2099, 2556 and 2622 to 2629;
i) amino acid sequences that have 3, 2, or 1 amino acid difference with at least one of the amino acid sequences of SEQ ID NO's: 1850 to 1928, 1940 to 2099, 2556 and 2622 to 2629.

In particular, such an amino acid sequence of the invention may be such that CDR1 is chosen from the group consisting of the amino acid sequences of SEQ ID NO's: 722 to 800, 812 to 971, 2484 and 2590 to 2597; and/or CDR2 is chosen from the group consisting of the amino acid sequences of SEQ ID NO's: 1286 to 1364, 1376 to 1535, 2520 and 2606 to 2613; and/or CDR3 is chosen from the group consisting of the amino acid sequences of SEQ ID NO's: 1850 to 1928, 1940 to 2099, 2556 and 2622 to 2629.

In particular, when the amino acid sequence of the invention essentially consists of 4 framework regions (FR1 to FR4, respectively) and 3 complementarity determining regions (CDR1 to CDR3, respectively), the amino acid sequence of the invention is preferably such that:

CDR1 is chosen from the group consisting of:

a) the amino acid sequences of SEQ ID NO's: 722 to 800, 812 to 971, 2484 and 2590 to 2597;

b) amino acid sequences that have at least 80% amino acid identity with at least one of the amino acid sequences of SEQ ID NO's: 722 to 800, 812 to 971, 2484 and 2590 to 2597;
c) amino acid sequences that have 3, 2, or 1 amino acid difference with at least one of the amino acid sequences of SEQ ID NO's: 722 to 800, 812 to 971, 2484 and 2590 to 2597;

and

CDR2 is chosen from the group consisting of:

d) the amino acid sequences of SEQ ID NO's: 1286 to 1364, 1376 to 1535, 2520 and 2606 to 2613;
e) amino acid sequences that have at least 80% amino acid identity with at least one of the amino acid sequences of SEQ ID NO's: 1286 to 1364, 1376 to 1535, 2520 and 2606 to 2613;
f) amino acid sequences that have 3, 2, or 1 amino acid difference with at least one of the amino acid sequences of SEQ ID NO's: 1286 to 1364, 1376 to 1535, 2520 and 2606 to 2613;

and

CDR3 is chosen from the group consisting of:

g) the amino acid sequences of SEQ ID NO's: 1850 to 1928, 1940 to 2099, 2556 and 2622 to 2629;
h) amino acid sequences that have at least 80% amino acid identity with at least one of the amino acid sequences of SEQ ID NO's: 1850 to 1928, 1940 to 2099, 2556 and 2622 to 2629;
i) amino acid sequences that have 3, 2, or 1 amino acid difference with at least one of the amino acid sequences of SEQ ID NO's: 1850 to 1928, 1940 to 2099, 2556 and 2622 to 2629; or any suitable fragment of such an amino acid sequence In particular, such an amino acid sequence of the invention may be such that CDR1 is chosen from the group consisting of the amino acid sequences of SEQ ID NO's: 722 to 800, 812 to 971, 2484 and 2590 to 2597; and CDR2 is chosen from the group consisting of the amino acid sequences of SEQ ID NO's: 1286 to 1364, 1376 to 1535, 2520 and 2606 to 2613; and CDR3 is chosen from the group consisting of the amino acid sequences of SEQ ID NO's: 1850 to 1928, 1940 to 2099, 2556 and 2622 to 2629.

Again, preferred combinations of CDR sequences will become clear from the further description herein.

Also, such amino acid sequences are preferably such that they can specifically bind (as defined herein) to at least one epitope of the F-protein of human RSV virus; and more in particular bind to the F-protein of human RSV virus with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

In one preferred, but non-limiting aspect, the invention relates to an amino acid sequence that essentially consists of 4 framework regions (FR1 to FR4, respectively) and 3 complementarity determining regions (CDR1 to CDR3, respectively), in which the CDR sequences of said amino acid sequence have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 158 to 236, 248 to 407, 2448 and 2574 to 2581. This degree of amino acid identity can for example be determined by determining the degree of amino acid identity (in a manner described herein) between said amino acid sequence and one or more of the sequences of SEQ ID NO's: 158 to 236, 248 to 407, 2448 and 2574 to 2581, in which the amino acid residues that form the framework regions are disregarded. Such amino acid sequences of the invention can be as further described herein.

In another specific, but again non-limiting aspect, the invention relates to an amino acid sequence directed against at least one epitope of the hemagglutinin of influenza virus.

In particular, the invention relates to an amino acid sequence directed against the hemagglutinin H5 protein of influenza virus that comprises one or more stretches of amino acid residues chosen from the group consisting of:

a) the amino acid sequences of SEQ ID NO's: 690 to 721, 2467 to 2483, 2754 to 2755 and 3194 to 3258;
b) amino acid sequences that have at least 80% amino acid identity with at least one of the amino acid sequences of SEQ ID NO's: 690 to 721, 2467 to 2483, 2754 to 2755 and 3194 to 3258;
c) amino acid sequences that have 3, 2, or 1 amino acid difference with at least one of the amino acid sequences of SEQ ID NO's: 690 to 721, 2467 to 2483, 2754 to 2755 and 3194 to 3258;
d) the amino acid sequences of SEQ ID NO's: 1254 to 1285, 2503 to 2519, 2826 to 2827 and 3324 to 3388;
e) amino acid sequences that have at least 80% amino acid identity with at least one of the amino acid sequences of SEQ ID NO's: 1254 to 1285, 2503 to 2519, 2826 to 2827 and 3324 to 3388;
f) amino acid sequences that have 3, 2, or 1 amino acid difference with at least one of the amino acid sequences of SEQ ID NO's: 1254 to 1285, 2503 to 2519, 2826 to 2827 and 3324 to 3388;
g) the amino acid sequences of SEQ ID NO's: 1818 to 1849, 2539 to 2555, 2898 to 2899 and 3454 to 3518;
h) amino acid sequences that have at least 80% amino acid identity with at least one of the amino acid sequences of SEQ ID NO's: 1818 to 1849, 2539 to 2555, 2898 to 2899 and 3454 to 3518;
i) amino acid sequences that have 3, 2, or 1 amino acid difference with at least one of the amino acid sequences of SEQ ID NO's: 1818 to 1849, 2539 to 2555, 2898 to 2899 and 3454 to 3518;

or any suitable combination thereof.

When an amino acid sequence of the invention contains one or more amino acid sequences according to b) and/or c):

i) any amino acid substitution in such an amino acid sequence according to b) and/or c) is preferably, and compared to the corresponding amino acid sequence according to a), a conservative amino acid substitution, (as defined herein);

and/or ii) the amino acid sequence according to b) and/or c) preferably only contains amino acid substitutions, and no amino acid deletions or insertions, compared to the corresponding amino acid sequence according to a);

and/or iii) the amino acid sequence according to b) and/or c) may be an amino acid sequence that is derived from an amino acid sequence according to a) by means of affinity maturation using one or more techniques of affinity maturation known per se.

Similarly, when an amino acid sequence of the invention contains one or more amino acid sequences according to e) and/or f):

i) any amino acid substitution in such an amino acid sequence according to e) and/or f) is preferably, and compared to the corresponding amino acid sequence according to d), a conservative amino acid substitution, (as defined herein);

and/or ii) the amino acid sequence according to e) and/or f) preferably only contains amino acid substitutions, and no amino acid deletions or insertions, compared to the corresponding amino acid sequence according to d);

and/or iii) the amino acid sequence according to e) and/or f) may be an amino acid sequence that is derived from an amino acid sequence according to d) by means of affinity maturation using one or more techniques of affinity maturation known per se.

Also, similarly, when an amino acid sequence of the invention contains one or more amino acid sequences according to h) and/or i):

i) any amino acid substitution in such an amino acid sequence according to h) and/or i) is preferably, and compared to the corresponding amino acid sequence according to g), a conservative amino acid substitution, (as defined herein);

and/or ii) the amino acid sequence according to h) and/or i) preferably only contains amino acid substitutions, and no amino acid deletions or insertions, compared to the corresponding amino acid sequence according to g);

and/or iii) the amino acid sequence according to h) and/or i) may be an amino acid sequence that is derived from an amino acid sequence according to g) by means of affinity maturation using one or more techniques of affinity maturation known per se.

It should be understood that the last preceding paragraphs also generally apply to any amino acid sequences of the invention that comprise one or more amino acid sequences according to b), c), e), f), h) or i), respectively.

In this specific aspect, the amino acid sequence preferably comprises one or more stretches of amino acid residues chosen from the group consisting of:

i) the amino acid sequences of SEQ ID NO's: 690 to 721, 2467 to 2483, 2754 to 2755 and 3194 to 3258;

ii) the amino acid sequences of SEQ ID NO's: 1254 to 1285, 2503 to 2519, 2826 to 2827 and 3324 to 3388; and iii) the amino acid sequences of SEQ ID NO's: 1818 to 1849, 2539 to 2555, 2898 to 2899 and 3454 to 3518;

or any suitable combination thereof.

Also, preferably, in such an amino acid sequence, at least one of said stretches of amino acid residues forms part of the antigen binding site for binding the hemagglutinin H5 protein of influenza virus.

In a more specific, but again non-limiting aspect, the invention relates to an amino acid sequence directed against at least one epitope of the hemagglutinin H5 protein of influenza virus, that comprises two or more stretches of amino acid residues chosen from the group consisting of:

a) the amino acid sequences of SEQ ID NO's: 690 to 721, 2467 to 2483, 2754 to 2755 and 3194 to 3258;

b) amino acid sequences that have at least 80% amino acid identity with at least one of the amino acid sequences of SEQ ID NO's: 690 to 721, 2467 to 2483, 2754 to 2755 and 3194 to 3258;

c) amino acid sequences that have 3, 2, or 1 amino acid difference with at least one of the amino acid sequences of SEQ ID NO's: 690 to 721, 2467 to 2483, 2754 to 2755 and 3194 to 3258;

d) the amino acid sequences of SEQ ID NO's: 1254 to 1285, 2503 to 2519, 2826 to 2827 and 3324 to 3388;

e) amino acid sequences that have at least 80% amino acid identity with at least one of the amino acid sequences of SEQ ID NO's: 1254 to 1285, 2503 to 2519, 2826 to 2827 and 3324 to 3388;

f) amino acid sequences that have 3, 2, or 1 amino acid difference with at least one of the amino acid sequences of SEQ ID NO's: 1254 to 1285, 2503 to 2519, 2826 to 2827 and 3324 to 3388;

g) the amino acid sequences of SEQ ID NO's: 1818 to 1849, 2539 to 2555, 2898 to 2899 and 3454 to 3518;

h) amino acid sequences that have at least 80% amino acid identity with at least one of the amino acid sequences of SEQ ID NO's: 1818 to 1849, 2539 to 2555, 2898 to 2899 and 3454 to 3518;

i) amino acid sequences that have 3, 2, or 1 amino acid difference with at least one of the amino acid sequences of SEQ ID NO's: 1818 to 1849, 2539 to 2555, 2898 to 2899 and 3454 to 3518;

such that (i) when the first stretch of amino acid residues corresponds to one of the amino acid sequences according to a), b) or c), the second stretch of amino acid residues corresponds to one of the amino acid sequences according to d), e), f), g), h) or i); (ii) when the first stretch of amino acid residues corresponds to one of the amino acid sequences according to d), e) or f), the second stretch of amino acid residues corresponds to one of the amino acid sequences according to a), b), c), g), h) or i); or (iii) when the first stretch of amino acid residues corresponds to one of the amino acid sequences according to g), h) or i), the second stretch of amino acid residues corresponds to one of the amino acid sequences according to a), b), c), d), e) or f).

In this specific aspect, the amino acid sequence preferably comprises two or more stretches of amino acid residues chosen from the group consisting of:

i) the amino acid sequences of SEQ ID NO's: 690 to 721, 2467 to 2483, 2754 to 2755 and 3194 to 3258 ii) the amino acid sequences of SEQ ID NO's: 1254 to 1285, 2503 to 2519, 2826 to 2827 and 3324 to 3388; and iii) the amino acid sequences of SEQ ID NO's: 1818 to 1849, 2539 to 2555, 2898 to 2899 and 3454 to 3518;

such that, (i) when the first stretch of amino acid residues corresponds to one of the amino acid sequences of SEQ ID NO's: 690 to 721, 2467 to 2483, 2754 to 2755 and 3194 to 3258, the second stretch of amino acid residues corresponds to one of the amino acid sequences of SEQ ID NO's: 1254 to 1285, 2503 to 2519, 2826 to 2827 and 3324 to 3388 or of SEQ ID NO's: 1818 to 1849, 2539 to 2555, 2898 to 2899 and 3454 to 3518; (ii) when the first stretch of amino acid residues corresponds to one of the amino acid sequences of SEQ ID NO's: 1254 to 1285, 2503 to 2519, 2826 to 2827 and 3324 to 3388, the second stretch of amino acid residues corresponds to one of the amino acid sequences of SEQ ID NO's: 690 to 721, 2467 to 2483, 2754 to 2755 and 3194 to 3258 or of SEQ ID NO's: 1818 to 1849, 2539 to 2555, 2898 to 2899 and 3454 to 3518; or (iii) when the first stretch of amino acid residues corresponds to one of the amino acid sequences of SEQ ID NO's: 1818 to 1849, 2539 to 2555, 2898 to 2899 and 3454 to 3518, the second stretch of amino acid residues corresponds to one of the amino acid sequences of SEQ ID NO's: 690 to 721, 2467 to 2483, 2754 to 2755 and 3194 to 3258 or of SEQ ID NO's: 1254 to 1285, 2503 to 2519, 2826 to 2827 and 3324 to 3388.

Also, in such an amino acid sequence, the at least two stretches of amino acid residues again preferably form part of the antigen binding site for binding to the hemagglutinin H5 protein of influenza virus.

In an even more specific, but non-limiting aspect, the invention relates to an amino acid sequence directed against at least one epitope of the hemagglutinin H5 protein of influenza virus, that comprises three or more stretches of amino acid residues, in which the first stretch of amino acid residues is chosen from the group consisting of:

a) the amino acid sequences of SEQ ID NO's: 690 to 721, 2467 to 2483, 2754 to 2755 and 3194 to 3258;
b) amino acid sequences that have at least 80% amino acid identity with at least one of the amino acid sequences of SEQ ID NO's: 690 to 721, 2467 to 2483, 2754 to 2755 and 3194 to 3258;
c) amino acid sequences that have 3, 2, or 1 amino acid difference with at least one of the amino acid sequences of SEQ ID NO's: 690 to 721, 2467 to 2483, 2754 to 2755 and 3194 to 3258;

the second stretch of amino acid residues is chosen from the group consisting of:

d) the amino acid sequences of SEQ ID NO's: 1254 to 1285, 2503 to 2519, 2826 to 2827 and 3324 to 3388;
e) amino acid sequences that have at least 80% amino acid identity with at least one of the amino acid sequences of SEQ ID NO's: 1254 to 1285, 2503 to 2519, 2826 to 2827 and 3324 to 3388;
f) amino acid sequences that have 3, 2, or 1 amino acid difference with at least one of the amino acid sequences of SEQ ID NO's: 1254 to 1285, 2503 to 2519, 2826 to 2827 and 3324 to 3388;

and the third stretch of amino acid residues is chosen from the group consisting of:

g) the amino acid sequences of SEQ ID NO's: 1818 to 1849, 2539 to 2555, 2898 to 2899 and 3454 to 3518;
h) amino acid sequences that have at least 80% amino acid identity with at least one of the amino acid sequences of SEQ ID NO's: 1818 to 1849, 2539 to 2555, 2898 to 2899 and 3454 to 3518;
i) amino acid sequences that have 3, 2, or 1 amino acid difference with at least one of the amino acid sequences of SEQ ID NO's: 1818 to 1849, 2539 to 2555, 2898 to 2899 and 3454 to 3518.

Preferably, in this specific aspect, the first stretch of amino acid residues is chosen from the group consisting of the amino acid sequences of SEQ ID NO's: 690 to 721 and 2467 to 2483; the second stretch of amino acid residues is chosen from the group consisting of the amino acid sequences of SEQ ID NO's: 1254 to 1285, 2503 to 2519, 2826 to 2827 and 3324 to 3388; and the third stretch of amino acid residues is chosen from the group consisting of the amino acid sequences of SEQ ID NO's: 1818 to 1849, 2539 to 2555, 2898 to 2899 and 3454 to 3518.

Again, preferably, in such an amino acid sequence, the at least three stretches of amino acid residues forms part of the antigen binding site for binding to the hemagglutinin H5 protein of influenza virus.

Preferred combinations of such stretches of amino acid sequences will become clear from the further disclosure herein.

Preferably, in such amino acid sequences the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 126 to 157, 2431 to 2447, 2682 to 2683 and 3064 to 3128 (see Table A-1). This degree of amino acid identity can for example be determined by determining the degree of amino acid identity (in a manner described herein) between said amino acid sequence and one or more of the sequences of SEQ ID NO's: 126 to 157, 2431 to 2447, 2682 to 2683 and 3064 to 3128 (see Table A-1), in which the amino acid residues that form the framework regions are disregarded. Also, such amino acid sequences of the invention can be as further described herein.

Also, such amino acid sequences are preferably such that they can specifically bind (as defined herein) to the hemagglutinin H5 protein of influenza virus; and more in particular bind to the hemagglutinin H5 protein of influenza virus with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

When the amino acid sequence of the invention essentially consists of 4 framework regions (FR1 to FR4, respectively) and 3 complementarity determining regions (CDR1 to CDR3, respectively), the amino acid sequence of the invention is preferably such that:

CDR1 is chosen from the group consisting of:

a) the amino acid sequences of SEQ ID NO's: 690 to 721, 2467 to 2483, 2754 to 2755 and 3194 to 3258;
b) amino acid sequences that have at least 80% amino acid identity with at least one of the amino acid sequences of SEQ ID NO's: 690 to 721, 2467 to 2483, 2754 to 2755 and 3194 to 3258;
c) amino acid sequences that have 3, 2, or 1 amino acid difference with at least one of the amino acid sequences of SEQ ID NO's: 690 to 721, 2467 to 2483, 2754 to 2755 and 3194 to 3258;

and/or

CDR2 is chosen from the group consisting of:

d) the amino acid sequences of SEQ ID NO's: 1254 to 1285, 2503 to 2519, 2826 to 2827 and 3324 to 3388;
e) amino acid sequences that have at least 80% amino acid identity with at least one of the amino acid sequences of SEQ ID NO's: 1254 to 1285, 2503 to 2519, 2826 to 2827 and 3324 to 3388;
f) amino acid sequences that have 3, 2, or 1 amino acid difference with at least one of the amino acid sequences of SEQ ID NO's: 1254 to 1285, 2503 to 2519, 2826 to 2827 and 3324 to 3388;

and/or

CDR3 is chosen from the group consisting of:

g) the amino acid sequences of SEQ ID NO's: 1818 to 1849, 2539 to 2555, 2898 to 2899 and 3454 to 3518;
h) amino acid sequences that have at least 80% amino acid identity with at least one of the amino acid sequences of SEQ ID NO's: 1818 to 1849, 2539 to 2555, 2898 to 2899 and 3454 to 3518;
i) amino acid sequences that have 3, 2, or 1 amino acid difference with at least one of the amino acid sequences of SEQ ID NO's: 1818 to 1849, 2539 to 2555, 2898 to 2899 and 3454 to 3518.

In particular, such an amino acid sequence of the invention may be such that CDR1 is chosen from the group consisting of the amino acid sequences of SEQ ID NO's: 690 to 721, 2467 to 2483, 2754 to 2755 and 3194 to 3258; and/or CDR2 is chosen from the group consisting of the amino acid sequences of SEQ ID NO's: 1254 to 1285, 2503 to 2519, 2826 to 2827 and 3324 to 3388; and/or CDR3 is chosen from the group consisting of the amino acid sequences of SEQ ID NO's: 1818 to 1849, 2539 to 2555, 2898 to 2899 and 3454 to 3518.

In particular, when the amino acid sequence of the invention essentially consists of 4 framework regions (FR1 to FR4, respectively) and 3 complementarity determining regions (CDR1 to CDR3, respectively), the amino acid sequence of the invention is preferably such that:

CDR1 is chosen from the group consisting of:

a) the amino acid sequences of SEQ ID NO's: 690 to 721, 2467 to 2483, 2754 to 2755 and 3194 to 3258;

b) amino acid sequences that have at least 80% amino acid identity with at least one of the amino acid sequences of SEQ ID NO's: 690 to 721, 2467 to 2483, 2754 to 2755 and 3194 to 3258;

c) amino acid sequences that have 3, 2, or 1 amino acid difference with at least one of the amino acid sequences of SEQ ID NO's: 690 to 721, 2467 to 2483, 2754 to 2755 and 3194 to 3258;

and

CDR2 is chosen from the group consisting of:

d) the amino acid sequences of SEQ ID NO's: 1254 to 1285, 2503 to 2519, 2826 to 2827 and 3324 to 3388;

e) amino acid sequences that have at least 80% amino acid identity with at least one of the amino acid sequences of SEQ ID NO's: 1254 to 1285, 2503 to 2519, 2826 to 2827 and 3324 to 3388;

f) amino acid sequences that have 3, 2, or 1 amino acid difference with at least one of the amino acid sequences of SEQ ID NO's: 1254 to 1285, 2503 to 2519, 2826 to 2827 and 3324 to 3388;

and

CDR3 is chosen from the group consisting of:

g) the amino acid sequences of SEQ ID NO's: 1818 to 1849, 2539 to 2555, 2898 to 2899 and 3454 to 3518;

h) amino acid sequences that have at least 80% amino acid identity with at least one of the amino acid sequences of SEQ ID NO's: 1818 to 1849, 2539 to 2555, 2898 to 2899 and 3454 to 3518;

i) amino acid sequences that have 3, 2, or 1 amino acid difference with at least one of the amino acid sequences of SEQ ID NO's: 1818 to 1849, 2539 to 2555, 2898 to 2899 and 3454 to 3518; or any suitable fragment of such an amino acid sequence.

In particular, such an amino acid sequence of the invention may be such that CDR1 is chosen from the group consisting of the amino acid sequences of SEQ ID NO's: 690 to 721, 2467 to 2483, 2754 to 2755 and 3194 to 3258; and CDR2 is chosen from the group consisting of the amino acid sequences of SEQ ID NO's: 1254 to 1285, 2503 to 2519, 2826 to 2827 and 3324 to 3388; and CDR3 is chosen from the group consisting of the amino acid sequences of SEQ ID NO's: 1818 to 1849, 2539 to 2555, 2898 to 2899 and 3454 to 3518.

Again, preferred combinations of CDR sequences will become clear from the further description herein.

Also, such amino acid sequences are preferably such that they can specifically bind (as defined herein) to the hemagglutinin H5 protein of influenza virus; and more in particular bind to the hemagglutinin H5 protein of influenza virus with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

In one preferred, but non-limiting aspect, the invention relates to an amino acid sequence that essentially consists of 4 framework regions (FR1 to FR4, respectively) and 3 complementarity determining regions (CDR1 to CDR3, respectively), in which the CDR sequences of said amino acid sequence have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 126 to 157, 2431 to 2447, 2682 to 2683 and 3064 to 3128. This degree of amino acid identity can for example be determined by determining the degree of amino acid identity (in a manner described herein) between said amino acid sequence and one or more of the sequences of SEQ ID NO's: 126 to 157, 2431 to 2447, 2682 to 2683 and 3064 to 3128, in which the amino acid residues that form the framework regions are disregarded. Such amino acid sequences of the invention can be as further described herein.

In particular, the invention relates to an amino acid sequence directed against at least one epitope of the G-protein of rabies virus that comprises one or more stretches of amino acid residues chosen from the group consisting of:

a) the amino acid sequences of SEQ ID NO's: 801 to 811 and 2756 to 2789;

b) amino acid sequences that have at least 80% amino acid identity with at least one of the amino acid sequences of SEQ ID NO's: 801 to 811 and 2756 to 2789;

c) amino acid sequences that have 3, 2, or 1 amino acid difference with at least one of the amino acid sequences of SEQ ID NO's: 801 to 811 and 2756 to 2789;

d) the amino acid sequences of SEQ ID NO's: 1365 to 1375 and 2828 to 2861;

e) amino acid sequences that have at least 80% amino acid identity with at least one of the amino acid sequences of SEQ ID NO's: 1365 to 1375 and 2828 to 2861;

f) amino acid sequences that have 3, 2, or 1 amino acid difference with at least one of the amino acid sequences of SEQ ID NO's: 1365 to 1375 and 2828 to 2861;

g) the amino acid sequences of SEQ ID NO's: 1929 to 1939 and 2900 to 2933;

h) amino acid sequences that have at least 80% amino acid identity with at least one of the amino acid sequences of SEQ ID NO's: 1929 to 1939 and 2900 to 2933;

i) amino acid sequences that have 3, 2, or 1 amino acid difference with at least one of the amino acid sequences of SEQ ID NO's: 1929 to 1939 and 2900 to 2933;

or any suitable combination thereof.

When an amino acid sequence of the invention contains one or more amino acid sequences according to b) and/or c):

i) any amino acid substitution in such an amino acid sequence according to b) and/or c) is preferably, and compared to the corresponding amino acid sequence according to a), a conservative amino acid substitution, (as defined herein);

and/or ii) the amino acid sequence according to b) and/or c) preferably only contains amino acid substitutions, and no amino acid deletions or insertions, compared to the corresponding amino acid sequence according to a);

and/or iii) the amino acid sequence according to b) and/or c) may be an amino acid sequence that is derived from an amino acid sequence according to a) by means of affinity maturation using one or more techniques of affinity maturation known per se.

Similarly, when an amino acid sequence of the invention contains one or more amino acid sequences according to e) and/or f):

i) any amino acid substitution in such an amino acid sequence according to e) and/or f) is preferably, and compared to the corresponding amino acid sequence according to d), a conservative amino acid substitution, (as defined herein);

and/or ii) the amino acid sequence according to e) and/or f) preferably only contains amino acid substitutions, and no amino acid deletions or insertions, compared to the corresponding amino acid sequence according to d);

and/or iii) the amino acid sequence according to e) and/or f) may be an amino acid sequence that is derived from an amino acid sequence according to d) by means of affinity maturation using one or more techniques of affinity maturation known per se.

Also, similarly, when an amino acid sequence of the invention contains one or more amino acid sequences according to h) and/or i):

i) any amino acid substitution in such an amino acid sequence according to h) and/or i) is preferably, and compared to the corresponding amino acid sequence according to g), a conservative amino acid substitution, (as defined herein);

and/or ii) the amino acid sequence according to h) and/or i) preferably only contains amino acid substitutions, and no amino acid deletions or insertions, compared to the corresponding amino acid sequence according to g);

and/or iii) the amino acid sequence according to h) and/or i) may be an amino acid sequence that is derived from an amino acid sequence according to g) by means of affinity maturation using one or more techniques of affinity maturation known per se.

It should be understood that the last preceding paragraphs also generally apply to any amino acid sequences of the invention that comprise one or more amino acid sequences according to b), c), e), f), h) or i), respectively.

In this specific aspect, the amino acid sequence preferably comprises one or more stretches of amino acid residues chosen from the group consisting of:

i) the amino acid sequences of SEQ ID NO's: 801 to 811 and 2756 to 2789;

ii) the amino acid sequences of SEQ ID NO's: 1365 to 1375 and 2828 to 2861; and iii) the amino acid sequences of SEQ ID NO's: 1929 to 1939 and 2900 to 2933;

or any suitable combination thereof.

Also, preferably, in such an amino acid sequence, at least one of said stretches of amino acid residues forms part of the antigen binding site for binding the G-protein of rabies virus.

In a more specific, but again non-limiting aspect, the invention relates to an amino acid sequence directed against at least one epitope of the G-protein of rabies virus, that comprises two or more stretches of amino acid residues chosen from the group consisting of:

a) the amino acid sequences of SEQ ID NO's: 801 to 811 and 2756 to 2789;

b) amino acid sequences that have at least 80% amino acid identity with at least one of the amino acid sequences of SEQ ID NO's: 801 to 811 and 2756 to 2789;

c) amino acid sequences that have 3, 2, or 1 amino acid difference with at least one of the amino acid sequences of SEQ ID NO's: 801 to 811 and 2756 to 2789;

d) the amino acid sequences of SEQ ID NO's: 1365 to 1375 and 2828 to 2861;

e) amino acid sequences that have at least 80% amino acid identity with at least one of the amino acid sequences of SEQ ID NO's: 1365 to 1375 and 2828 to 2861;

f) amino acid sequences that have 3, 2, or 1 amino acid difference with at least one of the amino acid sequences of SEQ ID NO's: 1365 to 1375 and 2828 to 2861;

g) the amino acid sequences of SEQ ID NO's: 1929 to 1939 and 2900 to 2933;

h) amino acid sequences that have at least 80% amino acid identity with at least one of the amino acid sequences of SEQ ID NO's: 1929 to 1939 and 2900 to 2933;

i) amino acid sequences that have 3, 2, or 1 amino acid difference with at least one of the amino acid sequences of SEQ ID NO's: 1929 to 1939 and 2900 to 2933;

such that (i) when the first stretch of amino acid residues corresponds to one of the amino acid sequences according to a), b) or c), the second stretch of amino acid residues corresponds to one of the amino acid sequences according to d), e), f), g), h) or i); (ii) when the first stretch of amino acid residues corresponds to one of the amino acid sequences according to d), e) or f), the second stretch of amino acid residues corresponds to one of the amino acid sequences according to a), b), c), g), h) or i); or (iii) when the first stretch of amino acid residues corresponds to one of the amino acid sequences according to g), h) or i), the second stretch of amino acid residues corresponds to one of the amino acid sequences according to a), b), c), d), e) or f).

In this specific aspect, the amino acid sequence preferably comprises two or more stretches of amino acid residues chosen from the group consisting of:

i) the amino acid sequences of SEQ ID NO's: 801 to 811 and 2756 to 2789;

ii) the amino acid sequences of SEQ ID NO's: 1365 to 1375 and 2828 to 2861; and iii) the amino acid sequences of SEQ ID NO's: 1929 to 1939 and 2900 to 2933;

such that, (i) when the first stretch of amino acid residues corresponds to one of the amino acid sequences of SEQ ID NO's: 801 to 811 and 2756 to 2789, the second stretch of amino acid residues corresponds to one of the amino acid sequences of SEQ ID NO's: 1365 to 1375 and 2828 to 2861 or of SEQ ID NO's: 1929 to 1939 and 2900 to 2933; (ii) when the first stretch of amino acid residues corresponds to one of the amino acid sequences of SEQ ID NO's: 1365 to 1375 and 2828 to 2861, the second stretch of amino acid residues corresponds to one of the amino acid sequences of SEQ ID NO's: 801 to 811 and 2756 to 2789 or of SEQ ID NO's: 1929 to 1939 and 2900 to 2933; or (iii) when the first stretch of amino acid residues corresponds to one of the amino acid sequences of SEQ ID NO's: 1929 to 1939 and 2900 to 2933, the second stretch of amino acid residues corresponds to one of the amino acid sequences of SEQ ID NO's: 801 to 811 and 2756 to 2789 or of SEQ ID NO's: 1365 to 1375 and 2828 to 2861.

Also, in such an amino acid sequence, the at least two stretches of amino acid residues again preferably form part of the antigen binding site for binding to the G-protein of rabies virus.

In an even more specific, but non-limiting aspect, the invention relates to an amino acid sequence directed against at least one epitope of the G-protein of rabies virus, that comprises three or more stretches of amino acid residues, in which the first stretch of amino acid residues is chosen from the group consisting of:

a) the amino acid sequences of SEQ ID NO's: 801 to 811 and 2756 to 2789;

b) amino acid sequences that have at least 80% amino acid identity with at least one of the amino acid sequences of SEQ ID NO's: 801 to 811 and 2756 to 2789;

c) amino acid sequences that have 3, 2, or 1 amino acid difference with at least one of the amino acid sequences of SEQ ID NO's: 801 to 811 and 2756 to 2789;

the second stretch of amino acid residues is chosen from the group consisting of:

d) the amino acid sequences of SEQ ID NO's: 1365 to 1375 and 2828 to 2861;

e)

f) amino acid sequences that have at least 80% amino acid identity with at least one of the amino acid sequences of SEQ ID NO's: 1365 to 1375 and 2828 to 2861;

g) amino acid sequences that have 3, 2, or 1 amino acid difference with at least one of the amino acid sequences of SEQ ID NO's: 1365 to 1375 and 2828 to 2861;

and the third stretch of amino acid residues is chosen from the group consisting of:

h) the amino acid sequences of SEQ ID NO's: 1929 to 1939 and 2900 to 2933;

i) amino acid sequences that have at least 80% amino acid identity with at least one of the amino acid sequences of SEQ ID NO's: 1929 to 1939 and 2900 to 2933;

j) amino acid sequences that have 3, 2, or 1 amino acid difference with at least one of the amino acid sequences of SEQ ID NO's: 1929 to 1939 and 2900 to 2933.

Preferably, in this specific aspect, the first stretch of amino acid residues is chosen from the group consisting of the amino acid sequences of SEQ ID NO's: 801 to 811 and 2756 to 2789; the second stretch of amino acid residues is chosen from the group consisting of the amino acid sequences of SEQ ID NO's: 1365 to 1375 and 2828 to 2861; and the third stretch of amino acid residues is chosen from the group consisting of the amino acid sequences of SEQ ID NO's: 1929 to 1939 and 2900 to 2933.

Again, preferably, in such an amino acid sequence, the at least three stretches of amino acid residues forms part of the antigen binding site for binding to the G-protein of rabies virus.

Preferred combinations of such stretches of amino acid sequences will become clear from the further disclosure herein.

Preferably, in such amino acid sequences the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 237 to 247 and 2684 to 2717 (see Table A-1). This degree of amino acid identity can for example be determined by determining the degree of amino acid identity (in a manner described herein) between said amino acid sequence and one or more of the sequences of SEQ ID NO's: 237 to 247 and 2684 to 2717 (see Table A-1), in which the amino acid residues that form the framework regions are disregarded. Also, such amino acid sequences of the invention can be as further described herein.

Also, such amino acid sequences are preferably such that they can specifically bind (as defined herein) to the G-protein of rabies virus; and more in particular bind to the G-protein of rabies virus with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

When the amino acid sequence of the invention essentially consists of 4 framework regions (FR1 to FR4, respectively) and 3 complementarity determining regions (CDR1 to CDR3, respectively), the amino acid sequence of the invention is preferably such that:

CDR1 is chosen from the group consisting of:

a) the amino acid sequences of SEQ ID NO's: 801 to 811 and 2756 to 2789;

b) amino acid sequences that have at least 80% amino acid identity with at least one of the amino acid sequences of SEQ ID NO's: 801 to 811 and 2756 to 2789;

c) amino acid sequences that have 3, 2, or 1 amino acid difference with at least one of the amino acid sequences of SEQ ID NO's: 801 to 811 and 2756 to 2789;

and/or

CDR2 is chosen from the group consisting of:

d) the amino acid sequences of SEQ ID NO's: 1365 to 1375 and 2828 to 2861;

e) amino acid sequences that have at least 80% amino acid identity with at least one of the amino acid sequences of SEQ ID NO's: 1365 to 1375 and 2828 to 2861;

f) amino acid sequences that have 3, 2, or 1 amino acid difference with at least one of the amino acid sequences of SEQ ID NO's: 1365 to 1375 and 2828 to 2861;

and/or

CDR3 is chosen from the group consisting of:

g) the amino acid sequences of SEQ ID NO's: 1929 to 1939 and 2900 to 2933;

h) amino acid sequences that have at least 80% amino acid identity with at least one of the amino acid sequences of SEQ ID NO's: 1929 to 1939 and 2900 to 2933;

i) amino acid sequences that have 3, 2, or 1 amino acid difference with at least one of the amino acid sequences of SEQ ID NO's: 1929 to 1939 and 2900 to 2933.

In particular, such an amino acid sequence of the invention may be such that CDR1 is chosen from the group consisting of the amino acid sequences of SEQ ID NO's: 801 to 811 and 2756 to 2789; and/or CDR2 is chosen from the group consisting of the amino acid sequences of SEQ ID NO's: 1365 to 1375 and 2828 to 2861; and/or CDR3 is chosen from the group consisting of the amino acid sequences of SEQ ID NO's: 1929 to 1939 and 2900 to 2933.

In particular, when the amino acid sequence of the invention essentially consists of 4 framework regions (FR1 to FR4, respectively) and 3 complementarity determining regions (CDR1 to CDR3, respectively), the amino acid sequence of the invention is preferably such that:

CDR1 is chosen from the group consisting of:

a) the amino acid sequences of SEQ ID NO's: 801 to 811 and 2756 to 2789;

b) amino acid sequences that have at least 80% amino acid identity with at least one of the amino acid sequences of SEQ ID NO's: 801 to 811 and 2756 to 2789;

c) amino acid sequences that have 3, 2, or 1 amino acid difference with at least one of the amino acid sequences of SEQ ID NO's: 801 to 811 and 2756 to 2789;

and

CDR2 is chosen from the group consisting of:

d) the amino acid sequences of SEQ ID NO's: 1365 to 1375 and 2828 to 2861;

e) amino acid sequences that have at least 80% amino acid identity with at least one of the amino acid sequences of SEQ ID NO's: 1365 to 1375 and 2828 to 2861;

f) amino acid sequences that have 3, 2, or 1 amino acid difference with at least one of the amino acid sequences of SEQ ID NO's: 1365 to 1375 and 2828 to 2861;

and

CDR3 is chosen from the group consisting of:

g) the amino acid sequences of SEQ ID NO's: 1929 to 1939 and 2900 to 2933;

h) amino acid sequences that have at least 80% amino acid identity with at least one of the amino acid sequences of SEQ ID NO's: 1929 to 1939 and 2900 to 2933;

i) amino acid sequences that have 3, 2, or 1 amino acid difference with at least one of the amino acid sequences of SEQ ID NO's: 1929 to 1939 and 2900 to 2933; or any suitable fragment of such an amino acid sequence.

In particular, such an amino acid sequence of the invention may be such that CDR1 is chosen from the group consisting of the amino acid sequences of SEQ ID NO's: 801 to 811 and 2756 to 2789; and CDR2 is chosen from the group consisting of the amino acid sequences of SEQ ID NO's: 1365 to 1375 and 2828 to 2861; and CDR3 is chosen from the group consisting of the amino acid sequences of SEQ ID NO's: 1929 to 1939 and 2900 to 2933.

Again, preferred combinations of CDR sequences will become clear from the further description herein.

Also, such amino acid sequences are preferably such that they can specifically bind (as defined herein) to the G-protein of rabies virus; and more in particular bind to the G-protein of rabies virus with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

In one preferred, but non-limiting aspect, the invention relates to an amino acid sequence that essentially consists of 4 framework regions (FR1 to FR4, respectively) and 3 complementarity determining regions (CDR1 to CDR3, respectively), in which the CDR sequences of said amino acid sequence have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 237 to 247 and 2684 to 2717. This degree of amino acid identity can for example be determined by determining the degree of amino acid identity (in a manner described herein) between said amino acid sequence and one or more of the sequences of SEQ ID NO's: 237 to 247 and 2684 to 2717, in which the amino acid residues that form the framework regions are disregarded. Such amino acid sequences of the invention can be as further described herein.

In such an amino acid sequence of the invention, the framework sequences may be any suitable framework sequences, and examples of suitable framework sequences will be clear to the skilled person, for example on the basis the standard handbooks and the further disclosure and prior art mentioned herein.

The framework sequences are preferably (a suitable combination of) immunoglobulin framework sequences or framework sequences that have been derived from immunoglobulin framework sequences (for example, by humanization or camelization). For example, the framework sequences may be framework sequences derived from a light chain variable domain (e.g. a $V_L$-sequence) and/or from a heavy chain variable domain (e.g. a $V_H$-sequence). In one particularly preferred aspect, the framework sequences are either framework sequences that have been derived from a $V_{HH}$-sequence (in which said framework sequences may optionally have been partially or fully humanized) or are conventional $V_H$ sequences that have been camelized (as defined herein).

The framework sequences are preferably such that the amino acid sequence of the invention is a domain antibody (or an amino acid sequence that is suitable for use as a domain antibody); is a single domain antibody (or an amino acid sequence that is suitable for use as a single domain antibody); is a "dAb" (or an amino acid sequence that is suitable for use as a dAb); or is a NANOBODY® ($V_{HH}$ sequence) (including but not limited to $V_{HH}$ sequence). Again, suitable framework sequences will be clear to the skilled person, for example on the basis the standard handbooks and the further disclosure and prior art mentioned herein.

In particular, the framework sequences present in the amino acid sequences of the invention may contain one or more of Hallmark residues (as defined herein), such that the amino acid sequence of the invention is a NANOBODY® ($V_{HH}$ sequence). Some preferred, but non-limiting examples of (suitable combinations of) such framework sequences will become clear from the further disclosure herein.

Again, as generally described herein for the amino acid sequences of the invention, it is also possible to use suitable fragments (or combinations of fragments) of any of the foregoing, such as fragments that contain one or more CDR sequences, suitably flanked by and/or linked via one or more framework sequences (for example, in the same order as these CDR's and framework sequences may occur in the full-sized immunoglobulin sequence from which the fragment has been derived). Such fragments may also again be such that they comprise or can form an immunoglobulin fold, or alternatively be such that they do not comprise or cannot form an immunoglobulin fold.

In one specific aspect, such a fragment comprises a single CDR sequence as described herein (and in particular a CDR3 sequence), that is flanked on each side by (part of) a framework sequence (and in particular, part of the framework sequence(s) that, in the immunoglobulin sequence from which the fragment is derived, are adjacent to said CDR sequence. For example, a CDR3 sequence may be preceded by (part of) a FR3 sequence and followed by (part of) a FR4 sequence). Such a fragment may also contain a disulphide bridge, and in particular a disulphide bridge that links the two framework regions that precede and follow the CDR sequence, respectively (for the purpose of forming such a disulphide bridge, cysteine residues that naturally occur in said framework regions may be used, or alternatively cysteine residues may be synthetically added to or introduced into said framework regions). For a further description of these "Expedite fragments", reference is again made to WO 03/050531, as well as to WO 08/068280.

In another aspect, the invention relates to a compound or construct, and in particular a protein or polypeptide (also referred to herein as a "compound of the invention" or "polypeptide of the invention", respectively) that comprises or essentially consists of one or more amino acid sequences of the invention (or suitable fragments thereof), and optionally further comprises one or more other groups, residues, moieties or binding units. As will become clear to the skilled person from the further disclosure herein, such further groups, residues, moieties, binding units or amino acid sequences may or may not provide further functionality to the amino acid sequence of the invention (and/or to the compound or construct in which it is present) and may or may not modify the properties of the amino acid sequence of the invention.

For example, such further groups, residues, moieties or binding units may be one or more additional amino acid sequences, such that the compound or construct is a (fusion) protein or (fusion) polypeptide. In a preferred but non-limiting aspect, said one or more other groups, residues, moieties or binding units are immunoglobulin sequences. Even more preferably, said one or more other groups, residues, moieties or binding units are chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or NANOBODIES® ($V_{HH}$ sequences).

Alternatively, such groups, residues, moieties or binding units may for example be chemical groups, residues, moieties, which may or may not by themselves be biologically and/or pharmacologically active. For example, and without limitation, such groups may be linked to the one or more amino acid sequences of the invention so as to provide a "derivative" of an amino acid sequence or polypeptide of the invention, as further described herein.

Also within the scope of the present invention are compounds or constructs, that comprises or essentially consists of one or more derivatives as described herein, and optionally further comprises one or more other groups, residues, moieties or binding units, optionally linked via one or more linkers. Preferably, said one or more other groups, residues, moieties or binding units are amino acid sequences.

In the compounds or constructs described above, the one or more amino acid sequences of the invention and the one or more groups, residues, moieties or binding units may be linked directly to each other and/or via one or more suitable linkers or spacers. For example, when the one or more groups, residues, moieties or binding units are amino acid sequences, the linkers may also be amino acid sequences, so that the resulting compound or construct is a fusion (protein) or fusion (polypeptide).

As will be clear from the further description above and herein, this means that the amino acid sequences of the invention can be used as "building blocks" to form polypeptides of the invention, i.e. by suitably combining them with other groups, residues, moieties or binding units, in order to form compounds or constructs as described herein (such as, without limitations, the bi-, tri-, multiparatopic, bi-, tri-, multivalent and bi-, tri-, multispecific polypeptides of the invention described herein) which combine within one molecule one or more desired properties or biological functions.

The compounds or polypeptides of the invention can generally be prepared by a method which comprises at least one step of suitably linking the one or more amino acid sequences of the invention to the one or more further groups, residues, moieties or binding units, optionally via the one or more suitable linkers, so as to provide the compound or polypeptide of the invention. Polypeptides of the invention can also be prepared by a method which generally comprises at least the steps of providing a nucleic acid that encodes a polypeptide of the invention, expressing said nucleic acid in a suitable manner, and recovering the expressed polypeptide of the invention. Such methods can be performed in a manner known per se, which will be clear to the skilled person, for example on the basis of the methods and techniques further described herein.

The process of designing/selecting and/or preparing a compound or polypeptide of the invention, starting from an amino acid sequence of the invention, is also referred to herein as "formatting" said amino acid sequence of the invention; and an amino acid of the invention that is made part of a compound or polypeptide of the invention is said to be "formatted" or to be "in the format of" said compound or polypeptide of the invention. Examples of ways in which an amino acid sequence of the invention can be formatted and examples of such formats will be clear to the skilled person based on the disclosure herein; and such formatted amino acid sequences form a further aspect of the invention.

In one specific aspect of the invention, a compound of the invention or a polypeptide of the invention may have an increased half-life, compared to the corresponding amino acid sequence of the invention. Some preferred, but non-limiting examples of such compounds and polypeptides will become clear to the skilled person based on the further disclosure herein, and for example comprise amino acid sequences or polypeptides of the invention that have been chemically modified to increase the half-life thereof (for example, by means of pegylation); amino acid sequences of the invention that comprise at least one additional binding site for binding to a serum protein (such as serum albumin); or polypeptides of the invention that comprise at least one amino acid sequence of the invention that is linked to at least one moiety (and in particular at least one amino acid sequence) that increases the half-life of the amino acid sequence of the invention. Examples of polypeptides of the invention that comprise such half-life extending moieties or amino acid sequences will become clear to the skilled person based on the further disclosure herein; and for example include, without limitation, polypeptides in which the one or more amino acid sequences of the invention are suitable linked to one or more serum proteins or fragments thereof (such as (human) serum albumin or suitable fragments thereof) or to one or more binding units that can bind to serum proteins (such as, for example, domain antibodies, amino acid sequences that are suitable for use as a domain antibody, single domain antibodies, amino acid sequences that are suitable for use as a single domain antibody, "dAb"'s, amino acid sequences that are suitable for use as a dAb, or NANOBODIES® ($V_{HH}$ sequences) that can bind to serum proteins such as serum albumin (such as human serum albumin), serum immunoglobulins such as IgG, or transferrin; reference is made to the further description and references mentioned herein); polypeptides in which an amino acid sequence of the invention is linked to an Fc portion (such as a human Fc) or a suitable part or fragment thereof; or polypeptides in which the one or more amino acid sequences of the invention are suitable linked to one or more small proteins or peptides that can bind to serum proteins (such as, without limitation, the proteins and peptides described in WO 91/01743, WO 01/45746, WO 02/076489 and in WO 08/068280.

Generally, the compounds or polypeptides of the invention with increased half-life preferably have a half-life that is at least 1.5 times, preferably at least 2 times, such as at least 5 times, for example at least 10 times or more than 20 times, greater than the half-life of the corresponding amino acid sequence of the invention per se.

In a preferred, but non-limiting aspect of the invention, such compounds or polypeptides of the invention have a serum half-life that is increased with more than 1 hours, preferably more than 2 hours, more preferably more than 6 hours, such as more than 12 hours, or even more than 24, 48 or 72 hours, compared to the corresponding amino acid sequence of the invention per se.

In another preferred, but non-limiting aspect of the invention, such compounds or polypeptides of the invention exhibit a serum half-life in human of at least about 12 hours, preferably at least 24 hours, more preferably at least 48 hours, even more preferably at least 72 hours or more. For example, compounds or polypeptides of the invention may have a half-life of at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).

In another aspect, the invention relates to a nucleic acid that encodes an amino acid sequence of the invention or a polypeptide of the invention (or a suitable fragment thereof). Such a nucleic acid will also be referred to herein as a "nucleic acid of the invention" and may for example be in the form of a genetic construct, as further described herein.

In another aspect, the invention relates to a host or host cell that expresses (or that under suitable circumstances is capable of expressing) an amino acid sequence of the invention and/or a polypeptide of the invention; and/or that contains a nucleic acid of the invention. Some preferred but non-limiting examples of such hosts or host cells will become clear from the further description herein.

The invention further relates to a product or composition containing or comprising at least one amino acid sequence of the invention, at least one polypeptide of the invention (or a suitable fragment thereof), at least one compound of the invention and/or at least one nucleic acid of the invention, and optionally one or more further components of such compositions known per se, i.e. depending on the intended use of the composition. Such a product or composition may for example be a pharmaceutical composition (as described herein), a veterinary composition or a product or composition for diagnostic use (as also described herein). Some preferred but non-limiting examples of such products or compositions will become clear from the further description herein.

The invention also relates to the use of an amino acid sequence, NANOBODY® ($V_{HH}$ sequence), compound or polypeptide of the invention, or of a composition comprising the same, in (methods or compositions for) modulating viral entry and/or viral replication and/or for modulating the biological pathways that are mediated by an envelope protein of a virus (and/or its viral receptor) either in vitro (e.g. in an in vitro or cellular assay) or in vivo (e.g. in an a single cell or in a multicellular organism, and in particular in a mammal, and more in particular in a human being, such as in a human being that is at risk of or suffers from a viral disease).

The invention also relates to methods for modulating viral entry and/or viral replication and/or for modulating the biological pathways that are mediated by an envelope protein of a virus (and/or its viral receptor) either in vitro (e.g. in an in vitro or cellular assay) or in vivo (e.g. in an a single cell or multicellular organism, and in particular in a mammal, and more in particular in a human being, such as in a human being that is at risk of or suffers from a viral disease), which method comprises at least the step of contacting an envelope protein of a virus with at least one amino acid sequence, NANOBODY® ($V_{HH}$ sequence), compound or polypeptide of the invention, or with a composition comprising the same, in a manner and in an amount suitable to modulate viral entry and/or viral replication and/or to modulate the biological pathways that are mediated by an envelope protein of a virus and/or its viral receptor, with at least one amino acid sequence, NANOBODY® ($V_{HH}$ sequence), compound or polypeptide of the invention.

The invention also relates to the use of an one amino acid sequence, NANOBODY® ($V_{HH}$ sequence), compound or polypeptide of the invention in the preparation of a composition (such as, without limitation, a pharmaceutical composition or preparation as further described herein) for modulating viral entry and/or viral replication and/or for modulating the biological pathways that are mediated by an envelope protein of a virus (and/or its viral receptor), either in vitro (e.g. in an in vitro or cellular assay) or in vivo (e.g. in an a single cell or multicellular organism, and in particular in a mammal, and more in particular in a human being, such as in a human being that is at risk of or suffers from a viral disease.

In the context of the present invention, "modulating" or "to modulate" generally means either reducing, preventing or inhibiting viral entry and/or viral replication and/or reducing, preventing or inhibiting the biological pathways that are mediated by an envelope protein of a virus and/or its viral receptor, as measured using a suitable in vitro, cellular or in vivo assay (such as those mentioned herein). In particular, "modulating" or "to modulate" may mean either reducing, preventing or inhibiting viral entry and/or viral replication and/or reducing, preventing or inhibiting the biological pathways that are mediated by an envelope protein of a virus and/or its viral receptor as measured using a suitable in vitro, cellular or in vivo assay (such as those mentioned herein), by at least 1%, preferably at least 5%, such as at least 10% or at least 25%, for example by at least 50%, at least 60%, at least 70%, at least 80%, or 90% or more, compared to normal (i.e. naturally occurring) viral entry and/or viral replication and/or normal (i.e. naturally occurring) biological pathways that are mediated by an envelope protein of a virus and/or its viral receptor in the same assay under the same conditions but without the presence of the amino acid sequence, NANOBODY® ($V_{HH}$ sequence), compound or polypeptide of the invention.

As will be clear to the skilled person, "modulating" may also involve effecting a change (which may either be an increase or a decrease) in binding specificity and/or selectivity of an envelope protein of a virus for one or more of its binding partners; and/or effecting a change (which may either be an increase or a decrease) in the sensitivity of an envelope protein of a virus for one or more conditions in the medium or surroundings in which an envelope protein of a virus is present (such as pH, ion strength, the presence of co-factors, etc.), compared to the same conditions but without the presence of the amino acid sequence, NANOBODY® ($V_{HH}$ sequence), compound or polypeptide of the invention. As will be clear to the skilled person, this may again be determined in any suitable manner and/or using any suitable assay known per se, such as the assays described herein or in the prior art cited herein.

"Modulating" may also mean effecting a change with respect to one or more biological or physiological mechanisms, effects, responses, functions, pathways or activities in which an envelope protein of a virus (or in which its binding partners or pathway(s) are involved) is involved. Again, as will be clear to the skilled person this may be determined in any suitable manner and/or using any suitable (in vitro and usually cellular or in assay) assay known per se, such as the assays described herein or in the prior art cited herein. In particular, with respect to one or more biological or physiological mechanisms, effects, responses, functions, pathways or activities in which an envelope protein of a virus and/or its viral receptor is involved, effecting a change can mean a change by at least 1%, preferably at least 5%, such as at least 10% or at least 25%, for example by at least 50%, at least 60%, at least 70%, at least 80%, or 90% or more, compared to the biological or physiological mechanisms, effects, responses, functions, pathways or activities in the same assay under the same conditions but without the presence of the amino acid sequence, NANOBODY® ($V_{HH}$ sequence), compound or polypeptide of the invention.

Modulating may for example involve reducing, preventing or inhibiting the binding of an envelope protein of a virus to one of its binding partners and/or competing with a natural binding partner for binding to an envelope protein of a virus. Modulating may be reversible or irreversible, but for pharmaceutical and pharmacological purposes will usually be in a reversible manner.

Accordingly, the present invention also relates to amino acid sequences and polypeptides that can be used to modulate, and in particular to inhibit and/or to prevent the viral-mediated biological pathways in which an envelope protein of a virus and/or a viral receptor are involved. In particular, the amino acid sequences and polypeptides of the present invention can be used to neutralize a virus (as defined herein) and/or to modulate, reduce and/or inhibit the infectivity of a virus (as defined herein).

More specifically, the amino acid sequences and polypeptides according to the present invention may neutralize a virus (as defined herein) and/or modulate, reduce and/or inhibit the infectivity of a virus (as defined herein) in the pre-entry phase of viral infection (i.e. before and/or during viral entry in a target host cell has taken place) and/or in the post-entry phase of viral infection (i.e. after viral entry in a target host cell has taken place). Accordingly, the amino acid sequences and polypeptides of the present invention that neutralize a virus (as defined herein) and/or modulate, reduce and/or inhibit the infectivity of a virus (as defined herein) in the pre-entry phase of viral infection (i.e. before and/or during viral entry in a target host cell has taken place), are said herein to modulate and in particular inhibit and/or prevent viral entry (as further defined herein) in a target host cell. Furthermore, the amino acid sequences and polypeptides of the present invention that neutralize a virus (as defined herein) and/or modulate, reduce and/or inhibit the infectivity of a virus (as defined herein) in the post-entry phase of viral infection (i.e. after viral entry in a target host cell has taken place), are said herein to modulate and in particular inhibit and/or prevent viral replication (as further defined herein) in a target host cell.

In a specific aspect, the present invention relates to multivalent (such as bivalent, biparatopic, bispecific, trivalent, triparatopic, trispecific, as further defined herein) amino acid sequences and polypeptides that modulate, and in particular to inhibit and/or to prevent the viral-mediated biological pathways in which an envelope protein of a virus and/or a viral receptor are involved. In particular, the multivalent (preferably bivalent, more preferably trivalent) amino acid sequences and polypeptides of the present invention can neutralize a virus (as defined herein) and/or to modulate, reduce and/or inhibit the infectivity of a virus (as defined herein). In one aspect, these multivalent (preferably bivalent, more preferably trivalent) amino acid sequences and polypeptides are directed against hemagglutinint H5 envelope protein of influenza and show increased in vitro and/or in vivo neutralization of influenza virus (as e.g. measured by a pseudotype neutralization assay such as described herein) compared to the corresponding monovalent amino acid sequence. The neutralization may be increased by at least 2 times, preferably at least 3 times, such as at least 5 times or at least 10 times, for example by at least 15 times, at least 20 times, at least 30 times, at least 50 times, or 100 times or more, compared to the neutralization in the same assay under the same conditions by the corresponding monovalent amino acid sequence. In another aspect, these multivalent (preferably bivalent, more preferably trivalent) amino acid sequences and polypeptides are directed against the G envelope protein of rabies and show increased in vitro and/or in vivo neutralization of rabies (as e.g. measured by a RFITT assay such as described herein) compared to the corresponding monovalent amino acid sequence. The neutralization may be increased by at least 2 times, preferably at least 3 times, such as at least 5 times or at least 10 times, for example by at least 15 times, at least 20 times, at least 30 times, at least 50 times, or 100 times or more, compared to the neutralization in the same assay under the same conditions by the corresponding monovalent amino acid sequence. In another aspect, these multivalent (preferably bivalent, more preferably trivalent) amino acid sequences and polypeptides are directed against F-protein of RSV and show increased in vitro and/or in vivo neutralization of RSV compared to the corresponding monovalent amino acid sequence. The neutralization may be increased by at least 2 times, preferably at least 3 times, such as at least 5 times or at least 10 times, for example by at least 15 times, at least 20 times, at least 30 times, at least 50 times, or 100 times or more, compared to the neutralization in the same assay under the same conditions by the corresponding monovalent amino acid sequence. In yet another aspect, these multivalent (preferably bivalent, more preferably trivalent) amino acid sequences and polypeptides are directed against hemagglutinin H5 envelope protein of influenza and show increased competition with sialic acid for binding hemagglutinint H5 envelope protein of influenza compared to the corresponding monovalent amino acid sequence. The competition may be increased by at least 2 times, preferably at least 3 times, such as at least 5 times or at least 10 times, for example by at least 15 times, at least 20 times, at least 30 times, at least 50 times, or 100 times or more, compared to the competition in the same assay under the same conditions by the corresponding monovalent amino acid sequence. In yet another aspect, these multivalent (preferably bivalent, more preferably trivalent) amino acid sequences and polypeptides show increased cross reactivity and/or neutralization of different genotypes, subtypes, escape mutants and/or strains of a certain virus. In one aspect, these multivalent (preferably bivalent, more preferably trivalent) amino acid sequences and polypeptides are directed against the G envelope protein of rabies and may show cross reactivity and/or neutralization of different genotypes of rabies (such as e.g. genotype 1 and 5). In another aspect, these multivalent (preferably bivalent, more preferably trivalent) amino acid sequences and polypeptides are directed against hemagglutinin H5 envelope protein of influenza and show cross reactivity and/or neutralization of different subtypes and/or strains of influenza virus (such as e.g. H5N1 and H1N1; H3N2 and H1N1; H5N1 and H3N2; H5N1 and H2N2; H5N1, H1N1 and H3N2; H5N1, H2N2 and H3N2; H5N1, H1N1 and H2N2; H5N1, H1N1, H2N2 and H3N2). In yet another aspect, these multivalent (preferably bivalent, more preferably trivalent) amino acid sequences and polypeptides are directed against F protein of RSV and show cross reactivity and/or neutralization of different strains (such as e.g. Long and A-2, Long and B-1, A-2 and B-1, Long, A-2 and B-1) of RSV. In yet another aspect, these multivalent (preferably bivalent, more preferably trivalent) amino acid sequences and polypeptides are directed against F protein of RSV and show cross reactivity and/or neutralization of different escape mutants of RSV (such as e.g. escape mutants in antigenic site II, escape mutants in antigenic site IV-VI, and/or escape mutants in both antigenic site II and antigenic site IV-VI).

Accordingly, the amino acid sequences and (multivalent) polypeptides of the present invention can modulate and in particular inhibit and/or prevent viral entry and/or viral replication in a target host cell by specifically binding to an envelope protein of a virus at any suitable stage of said biological pathway(s); preferably, the amino acid sequences and polypeptides of the present invention can modulate and in particular inhibit and/or prevent viral entry in a target host cell by binding to an envelope protein of a virus, such that virion aggregation is induced and/or virion structure is destabilized and/or virion attachment to a target host cell is modulated, inhibited and/or prevented (for instance by modulating and/or inhibiting and/or preventing the interaction between the an envelope protein of a virus and a viral receptor on a target host cell and/or the interaction between the an envelope protein of a virus and a target host cell or by competing with said envelope protein for binding to said viral receptor or said target host cell) and/or viral fusion with said target host cell is modulated, inhibited and/or prevented (for instance at the target host cell membrane or within an endosomal and/or lysosomal compartment of said target host cell), for example by preventing said envelope protein of a virus from undergoing a conformational change. Alternatively, the amino acid sequences and polypeptides of the present invention can modulate and in particular inhibit and/or prevent viral replication (as defined herein) in a target host cell by specifically binding to an envelope protein of a virus at any suitable stage of said biological pathway; preferably, the amino acid sequences of the present invention can modulate and in particular inhibit and/or prevent viral replication in a target host cell by binding to an envelope protein of a virus, such that transcription and/or translation of the viral genome is affected, inhibited and/or prevented and/or viral packaging and/or the formation of functional virions is affected, inhibited and/or prevented and/or budding of nascent virions from the target host cell membrane is reduced, inhibited and/or prevented.

Also according to this aspect, bi- and multivalent (as defined herein), bi- and multispecific (as defined herein) and bi- and multiparatopic (as defined herein) polypeptides according to the invention may be useful for the prevention and/or treatment of viral diseases by specifically binding to at least one epitope of an envelope protein of a virus and at least one further epitope (which may or may not be different from said at least one epitope) of a target, wherein said target may or may not be different from said envelope protein.

Accordingly, the present invention also relates to biparatopic amino acid sequences and polypeptides according to the invention or compositions comprising the same, that combine two different modes of action, for example reducing, preventing and/or inhibiting viral entry (such for example at the stage of viral attachment, viral fusion, etc.) and/or viral replication (such for example at the stage of transcription, translation, viral packaging, budding, etc.), each mediated by one of the binding units of the biparatopic amino acid sequence and/or polypeptide of the invention, wherein each binding unit binds to a different site of said envelope protein of a virus.

Furthermore, the present invention also relates to triparatopic amino acid sequences and polypeptides according to the invention or compositions comprising the same, that combine two or three different modes of action, such as reducing, preventing and/or inhibiting viral entry (such for example at the stage of viral attachment, viral fusion, etc.) and/or viral replication (such for example at the stage of transcription, translation, viral packaging, budding, etc.), each mediated by one of the binding units of the triparatopic amino acid sequence and/or polypeptide of the invention, wherein each binding unit binds to a different site of said envelope protein of a virus.

More generally, the present invention relates to multiparatopic amino acid sequences and polypeptides according to the invention or compositions comprising the same, that combine two or more different modes of action, such as reducing, preventing and/or inhibiting viral entry (such for example at the stage of viral attachment, viral fusion, etc.) and/or viral replication (such for example at the stage of transcription, translation, viral packaging, budding, etc.), each mediated by one of the binding units of the multiparatopic amino acid sequence and/or polypeptide of the invention, wherein each binding unit binds to a different site of said envelope protein of a virus.

The invention further relates to methods for preparing or generating the amino acid sequences, polypeptides, nucleic acids, host cells, products and compositions described herein. Some preferred but non-limiting examples of such methods will become clear from the further description herein.

Generally, these methods may comprise the steps of:

a) providing a set, collection or library of amino acid sequences; and b) screening said set, collection or library of amino acid sequences for amino acid sequences that can bind to and/or have affinity for an envelope protein of a virus;

and c) isolating the amino acid sequence(s) that can bind to and/or have affinity for an envelope protein of a virus.

In such a method, the set, collection or library of amino acid sequences may be any suitable set, collection or library of amino acid sequences. For example, the set, collection or library of amino acid sequences may be a set, collection or library of immunoglobulin sequences (as described herein), such as a naïve set, collection or library of immunoglobulin sequences; a synthetic or semi-synthetic set, collection or library of immunoglobulin sequences; and/or a set, collection or library of immunoglobulin sequences that have been subjected to affinity maturation.

Also, in such a method, the set, collection or library of amino acid sequences may be a set, collection or library of heavy chain variable domains (such as $V_H$ domains or $V_{HH}$ domains) or of light chain variable domains. For example, the set, collection or library of amino acid sequences may be a set, collection or library of domain antibodies or single domain antibodies, or may be a set, collection or library of amino acid sequences that are capable of functioning as a domain antibody or single domain antibody.

In a preferred aspect of this method, the set, collection or library of amino acid sequences may be an immune set, collection or library of immunoglobulin sequences, for example derived from a mammal that has been suitably immunized with an envelope protein of a virus or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

In the above methods, the set, collection or library of amino acid sequences may be displayed on a phage, phagemid, ribosome or suitable micro-organism (such as yeast), such as to facilitate screening. Suitable methods, techniques and host organisms for displaying and screening (a set, collection or library of) amino acid sequences will be clear to the person skilled in the art, for example on the basis of the further disclosure herein. Reference is also made to the review by Hoogenboom in Nature Biotechnology, 23, 9, 1105-1116 (2005).

In another aspect, the method for generating amino acid sequences comprises at least the steps of:

a) providing a collection or sample of cells expressing amino acid sequences;

b) screening said collection or sample of cells for cells that express an amino acid sequence that can bind to and/or have affinity for an envelope protein of a virus;

and c) either (i) isolating said amino acid sequence; or (ii) isolating from said cell a nucleic acid sequence that encodes said amino acid sequence, followed by expressing said amino acid sequence.

For example, when the desired amino acid sequence is an immunoglobulin sequence, the collection or sample of cells may for example be a collection or sample of B-cells. Also, in this method, the sample of cells may be derived from a mammal that has been suitably immunized with an envelope protein of a virus or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

The above method may be performed in any suitable manner, as will be clear to the skilled person. Reference is for example made to EP 0 542 810, WO 05/19824, WO 04/051268 and WO 04/106377. The screening of step b) is preferably performed using a flow cytometry technique such as FACS. For this, reference is for example made to Lieby et al., Blood, Vol. 97, No. 12, 3820 (2001).

In another aspect, the method for generating an amino acid sequence directed against an envelope protein of a virus may comprise at least the steps of:

a) providing a set, collection or library of nucleic acid sequences encoding amino acid sequences;
b) screening said set, collection or library of nucleic acid sequences for nucleic acid sequences that encode an amino acid sequence that can bind to and/or has affinity for an envelope protein of a virus;

and c) isolating said nucleic acid sequence, followed by expressing said amino acid sequence. In such a method, the set, collection or library of nucleic acid sequences encoding amino acid sequences may for example be a set, collection or library of nucleic acid sequences encoding a naïve set, collection or library of immunoglobulin sequences; a set, collection or library of nucleic acid sequences encoding a synthetic or semi-synthetic set, collection or library of immunoglobulin sequences; and/or a set, collection or library of nucleic acid sequences encoding a set, collection or library of immunoglobulin sequences that have been subjected to affinity maturation.

Also, in such a method, the set, collection or library of nucleic acid sequences may encode a set, collection or library of heavy chain variable domains (such as $V_H$ domains or $V_{HH}$ domains) or of light chain variable domains. For example, the set, collection or library of nucleic acid sequences may encode a set, collection or library of domain antibodies or single domain antibodies, or a set, collection or library of amino acid sequences that are capable of functioning as a domain antibody or single domain antibody.

In a preferred aspect of this method, the set, collection or library of amino acid sequences may be an immune set, collection or library of nucleic acid sequences, for example derived from a mammal that has been suitably immunized with an envelope protein of a virus or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

The set, collection or library of nucleic acid sequences may for example encode an immune set, collection or library of heavy chain variable domains or of light chain variable domains. In one specific aspect, the set, collection or library of nucleotide sequences may encode a set, collection or library of $V_{HH}$ sequences.

In the above methods, the set, collection or library of nucleotide sequences may be displayed on a phage, phagemid, ribosome or suitable micro-organism (such as yeast), such as to facilitate screening. Suitable methods, techniques and host organisms for displaying and screening (a set, collection or library of) nucleotide sequences encoding amino acid sequences will be clear to the person skilled in the art, for example on the basis of the further disclosure herein. Reference is also made to the review by Hoogenboom in Nature Biotechnology, 23, 9, 1105-1116 (2005).

In another aspect, the method for generating an amino acid sequence directed against an envelope protein of a virus may comprise at least the steps of:

a) providing a set, collection or library of nucleic acid sequences encoding amino acid sequences;
b) screening said set, collection or library of nucleic acid sequences for nucleic acid sequences that encode an amino acid sequence that can bind to and/or has affinity for an envelope protein of a virus and that is cross-blocked or is cross blocking a NANOBODY® ($V_{HH}$ sequence) of the invention, e.g. one of SEQ ID NO's: 126 to 407, 2431 to 2448, 2574 to 2581, 2682 to 2717 and 3064 to 3128 (Table A-1), or a humanized version of a NANOBODY® ($V_{HH}$ sequence) of the invention, e.g. SEQ ID NO: 2999 to 3015 (see Table A-8), or a polypeptide or construct of the invention comprising at least one NANOBODY® ($V_{HH}$ sequence) of the invention, e.g. one of SEQ ID NO's: 2382 to 2415, 2423 to 2430, 2641 to 2659, 2663 to 2681, 2978 to 2998, 3016 to 3056 and 3584 to 3591 (see Table A-2, Table A-4, Table A-5, Table A-6, Table A-9 and Table A-10); and
c) isolating said nucleic acid sequence, followed by expressing said amino acid sequence.

The invention also relates to amino acid sequences that are obtainable and/or obtained by the above methods, or alternatively by a method that comprises the one of the above methods and in addition at least the steps of determining the nucleotide sequence or amino acid sequence of said immunoglobulin sequence; and of expressing or synthesizing said amino acid sequence in a manner known per se, such as by expression in a suitable host cell or host organism or by chemical synthesis.

Also, following the steps above, one or more amino acid sequences of the invention may be suitably humanized (or alternatively camelized); and/or the amino acid sequence(s) thus obtained may be linked to each other or to one or more other suitable amino acid sequences (optionally via one or more suitable linkers) so as to provide a polypeptide of the invention. Also, a nucleic acid sequence encoding an amino acid sequence of the invention may be suitably humanized (or alternatively camelized) and suitably expressed; and/or one or more nucleic acid sequences encoding an amino acid sequence of the invention may be linked to each other or to one or more nucleic acid sequences that encode other suitable amino acid sequences (optionally via nucleotide sequences that encode one or more suitable linkers), after which the nucleotide sequence thus obtained may be suitably expressed so as to provide a polypeptide of the invention.

Also encompassed within the present invention are methods for preparing and generating multivalent (such as e.g. bivalent, trivalent, etc.), multiparatopic (such as e.g. biparatopic, triparatopic, etc.) and/or multispecific (such as e.g. bispecific, trispecific, etc.) amino acids of the invention.

A method for preparing multivalent, multiparatopic and/or multispecific amino acids or constructs of the invention may comprise at least the steps of linking two or more monovalent amino acid sequences or monovalent constructs of the invention and for example one or more linkers together in a suitable manner. The monovalent constructs (and linkers) can be coupled by any method known in the art and as further described herein. Preferred techniques include the linking of the nucleic acid sequences that encode the monovalent constructs (and linkers) to prepare a genetic construct that expresses the multivalent, multiparatopic and/or multispecific amino acid or construct. Techniques for linking amino acid sequences or nucleic acid sequences will be clear to the skilled person, and reference is again made to the standard handbooks, such as Sambrook et al. and Ausubel et al., mentioned above, as well as the Examples below.

Accordingly, the present invention also relates to the use of a monovalent construct (which may comprise or essentially consists of an amino acid sequence of the invention such as a domain antibody, an amino acid sequence that is suitable for use as a domain antibody, a single domain antibody, an amino acid sequence that is suitable for use as a single domain antibody, a "dAb", an amino acid sequences that is suitable for use as a dAb, or a NANOBODY® ($V_{HH}$ sequence)) in providing and/or preparing a multivalent (such as multispecific, multiparatopic, and preferably trivalent, bivalent, triparatopic, biparatopic, trispecific, bispecific, etc.) compound or construct. The monovalent construct is then used as a binding domain or binding unit in providing and/or preparing the multivalent (such as multispecific, multiparatopic, and preferably trivalent, bivalent, triparatopic, biparatopic, trispecific, bispecific, etc.) construct comprising two (e.g. in a bivalent and/or biparatopic construct), three (e.g. in a trivalent and/or triparatopic construct) or more (e.g. in a multivalent and/or multiparatopic construct) binding units. In this respect, the monovalent construct may be used as a binding domain or binding unit in providing and/or preparing a multivalent and preferably bivalent or trivalent (such as multiparatopic, and preferably biparatopic or triparatopic) construct of the invention comprising two, three or more binding units.

In one aspect, the invention relates to multivalent polypeptides directed against the F-protein of RSV, in which at least one monovalent construct of the invention (and in particular at least one NANOBODY® ($V_{HH}$ sequence)) is used that is directed against the Synagis® binding site on the RSV F protein (and in particular against antigenic site II of the RSV F protein, and more in particular against region aa 250-275 of the RSV F protein) and/or that is capable of competing with Synagis® for binding to the RSV F protein.

In another aspect, the invention relates to multivalent polypeptides directed against the F-protein of RSV, in which at least one monovalent construct of the invention (and in particular at least one NANOBODY® ($V_{HH}$ sequence)) is used that is directed against the Synagis® binding site on the RSV F protein (and in particular against antigenic site II of the RSV F protein, and more in particular against region aa 250-275 of the RSV F protein) and/or that is capable of competing with Synagis® for binding to the RSV F protein; and at least one amino acid sequence of the invention (and in particular at least one NANOBODY® ($V_{HH}$ sequence)) is used that is directed against another antigenic determinant, epitope, part or domain of the RSV F protein. In such a preferred multiparatopic construct of the invention, the linker is most preferably such that the multiparatopic construct of the invention is capable of (simultaneously) binding to both the Synagis® binding site on the RSV F protein (and in particular against antigenic site II of the RSV F protein, and more in particular against the region aa 250-275 of the RSV F protein) as well as the other antigenic determinant, epitope, part or domain of the RSV F protein, again most preferably so as to allow binding with increased avidity and also intramolecular binding and/or recognition.

Accordingly, also encompassed in the present invention is the use of a monovalent construct comprising an amino acid of the invention (and in particular a NANOBODY® ($V_{HH}$ sequence)) that is directed against the Synagis® binding site on the RSV F protein (and in particular against antigenic site II of the RSV F protein, and more in particular against the region aa 250-275 of the RSV F protein) and/or that is capable of competing with Synagis® for binding to the RSV F protein, as a binding domain or binding unit in providing and/or preparing a multivalent or multiparatopic (such as multispecific, multiparatopic, and preferably trivalent, bivalent, triparatopic, biparatopic, trispecific, bispecific, etc.) construct, wherein the binding domains or binding units are linked via a linker such that the multivalent or multiparatopic (such as multispecific, multiparatopic, and preferably trivalent, bivalent, triparatopic, biparatopic, trispecific, bispecific, etc.) construct preferably exhibits intramolecular binding compared to intermolecular binding.

In yet another aspect, the invention relates to multivalent polypeptides directed against the F-protein of RSV, in which at least one monovalent construct of the invention (and in particular at least one NANOBODY® ($V_{HH}$ sequence)) is used that is directed against the 101F binding site on the RSV F protein (and in particular against antigenic site IV-VI of the RSV F protein, and more in particular against region aa 423-436 of the RSV F protein) and/or that is capable of competing with 101F for binding to the RSV F protein.

In yet another aspect, the invention relates to multivalent polypeptides directed against the F-protein of RSV, in which at least one monovalent construct of the invention (and in particular at least one NANOBODY® ($V_{HH}$ sequence)) is used that is directed against the 101F binding site on the RSV F protein (and in particular against antigenic site IV-VI of the RSV F protein, and more in particular against region aa 423-436 of the RSV F protein) and/or that is capable of competing with 101F for binding to the RSV F protein; and at least one amino acid sequence of the invention (and in particular at least one NANOBODY® ($V_{HH}$ sequence)) is used that is directed against another antigenic determinant, epitope, part or domain of the RSV F protein. In such a preferred multiparatopic construct of the invention, the linker is most preferably such that the multiparatopic construct of the invention is capable of (simultaneously) binding to both the 101F binding site on the RSV F protein (and in particular against antigenic site IV-VI of the RSV F protein, and more in particular against the region aa 423-436 of the RSV F protein) as well as the other antigenic determinant, epitope, part or domain of the RSV F protein, again most preferably so as to allow binding with increased avidity and also intramolecular binding and/or recognition.

Accordingly, also encompassed in the present invention is the use of a monovalent construct comprising an amino acid of the invention (and in particular a NANOBODY® ($V_{HH}$ sequence)) that is directed against the 101F binding site on the RSV F protein (and in particular against antigenic site IV-VI of the RSV F protein, and more in particular against the region aa 423-436 of the RSV F protein) and/or that is capable of competing with 101F for binding to the RSV F protein, as a binding domain or binding unit in providing and/or preparing a multivalent or multiparatopic (such as multispecific, multiparatopic, and preferably trivalent, bivalent, triparatopic, biparatopic, trispecific, bispecific, etc.) construct, wherein the binding domains or binding units are linked via a linker such that the multivalent or multiparatopic (such as multispecific, multiparatopic, and preferably trivalent, bivalent, triparatopic, biparatopic, trispecific, bispecific, etc.) construct preferably exhibits intramolecular binding compared to intermolecular binding.

In yet another aspect, the invention relates to multivalent polypeptides directed against the F-protein of RSV, in which at least one monovalent construct of the invention (and in particular at least one NANOBODY® ($V_{HH}$ sequence)) is used that is directed against the Synagis® binding site on the RSV F protein (and in particular against antigenic site II of the RSV F protein, and more in particular against the region aa 250-275 of the RSV F protein) and/or that is capable of competing with Synagis® for binding to the RSV F protein; and at least one monovalent construct of the invention (and in particular at least one NANOBODY® ($V_{HH}$ sequence)) is used that is directed against the 101F binding site on the RSV F protein (and in particular against antigenic site IV-VI of the RSV F protein, and more in particular against region aa 423-436 of the RSV F protein) and/or that is capable of competing with 101F for binding to the RSV F protein. In such a preferred multiparatopic construct of the invention, the linker is most preferably such that the multiparatopic construct of the invention is capable of (simultaneously) binding to both the Synagis® binding site on the RSV F protein (and in particular against antigenic site II of the RSV F protein, and more in particular against the region aa 250-275 of the RSV F protein) as well as the 101F binding site on the RSV F protein (and in particular against antigenic site IV-VI of the RSV F protein, and more in particular against the region aa 423-436 of the RSV F protein), again most preferably so as to allow binding with increased avidity and also intramolecular binding and/or recognition.

Accordingly, also encompassed in the present invention is the use of a monovalent construct comprising an amino acid sequence of the invention (and in particular at least one NANOBODY® ($V_{HH}$ sequence)) that is directed against the 101F binding site on the RSV F protein (and in particular against antigenic site IV of the RSV F protein, and more in particular against the region aa 423-436 of the RSV F protein) and/or that is capable of competing with 101F for binding to the RSV F protein, and a monovalent construct comprising an amino acid of the invention (and in particular a NANOBODY® ($V_{HH}$ sequence)) that is directed against the Synagis® binding site on the RSV F protein (and in particular against antigenic site II of the RSV F protein, and more in particular against the region aa 250-275 of the RSV F protein) and/or that is capable of competing with Synagis® for binding to the RSV F protein, as binding domains or binding units in providing and/or preparing a multiparatopic (such as a biparatopic) construct, wherein the binding domains or binding units are linked via a linker such that the multiparatopic (such as biparatopic) construct preferably exhibits intramolecular binding compared to intermolecular binding.

In some of the most preferred biparatopic polypeptides of the invention, at least one monovalent construct of the invention (and in particular at least one NANOBODY® ($V_{HH}$ sequence)) is used that is directed against the Synagis® binding site on the RSV F protein (and in particular against antigenic site II of the RSV F protein, and more in particular against region aa 250-275 of the RSV F protein) and/or that is capable of competing with Synagis® for binding to the RSV F protein; and at least one amino acid sequence of the invention (and in particular at least one NANOBODY® ($V_{HH}$ sequence)) is used that is directed against another antigenic determinant, epitope, part or domain of the RSV F protein. In such a preferred biparatopic construct of the invention, the linker is most preferably such that the biparatopic construct of the invention is capable of (simultaneously) binding to both the Synagis® binding site on the RSV F protein (and in particular against antigenic site II of the RSV F protein, and more in particular against the region aa 250-275 of the RSV F protein) as well as the other antigenic determinant, epitope, part or domain of the RSV F protein, again most preferably so as to allow binding with increased avidity and also intramolecular binding and/or recognition.

Accordingly, also encompassed in the present invention is the use of a monovalent construct comprising an amino acid of the invention (and in particular a NANOBODY® ($V_{HH}$ sequence)) that is directed against the Synagis® binding site on the RSV F protein (and in particular against antigenic site II of the RSV F protein, and more in particular against the region aa 250-275 of the RSV F protein) and/or that is capable of competing with Synagis® for binding to the RSV F protein, as a binding domain or binding unit in providing and/or preparing a biparatopic construct, wherein the binding domains or binding units are linked via a linker such that the biparatopic construct preferably exhibits intramolecular binding compared to intermolecular binding.

In some of the most preferred biparatopic polypeptides of the invention, at least one monovalent construct of the invention (and in particular at least one NANOBODY® ($V_{HH}$ sequence)) is used that is directed against the 101F binding site on the RSV F protein (and in particular against antigenic site IV-VI of the RSV F protein, and more in particular against region aa 423-436 of the RSV F protein) and/or that is capable of competing with 101F for binding to the RSV F protein; and at least one amino acid sequence of the invention (and in particular at least one NANOBODY® ($V_{HH}$ sequence)) is used that is directed against another antigenic determinant, epitope, part or domain of the RSV F protein. In such a preferred biparatopic construct of the invention, the linker is most preferably such that the biparatopic construct of the invention is capable of (simultaneously) binding to both the 101F binding site on the RSV F protein (and in particular against antigenic site IV-VI of the RSV F protein, and more in particular against the region aa 423-436 of the RSV F protein) as well as the other antigenic determinant, epitope, part or domain of the RSV F protein, again most preferably so as to allow binding with increased avidity and also intramolecular binding and/or recognition.

Accordingly, also encompassed in the present invention is the use of a monovalent construct comprising an amino acid of the invention (and in particular a NANOBODY® ($V_{HH}$ sequence)) that is directed against the 101F binding site on the RSV F protein (and in particular against antigenic site IV-VI of the RSV F protein, and more in particular against the region aa 423-436 of the RSV F protein) and/or that is capable of competing with 101F for binding to the RSV F protein, as a binding domain or binding unit in providing and/or preparing a biparatopic construct, wherein the binding domains or binding units are linked via a linker such that the biparatopic construct preferably exhibits intramolecular binding compared to intermolecular binding.

In some of the most preferred biparatopic polypeptides of the invention, at least one monovalent construct of the invention (and in particular at least one NANOBODY® ($V_{HH}$ sequence)) is used that is directed against the Synagis® binding site on the RSV F protein (and in particular against antigenic site II of the RSV F protein, and more in particular against the region aa 250-275 of the RSV F protein) and/or that is capable of competing with Synagis® for binding to the RSV F protein; and at least one monovalent construct of the invention (and in particular at least one NANOBODY® ($V_{HH}$ sequence)) is used that is directed against the 101F binding site on the RSV F protein (and in particular against antigenic site IV-VI of the RSV F protein, and more in particular against region aa 423-436 of the RSV F protein) and/or that is capable of competing with 101F for binding to the RSV F protein. In such a preferred biparatopic construct of the invention, the linker is most preferably such that the biparatopic construct of the invention is capable of (simultaneously) binding to both the Synagis® binding site on the RSV F protein (and in particular against antigenic site II of the RSV F protein, and more in particular against the region aa 250-275 of the RSV F protein) as well as the 101F binding site on the RSV F protein (and in particular against antigenic site IV-VI of the RSV F protein, and more in particular against the region aa 423-436 of the RSV F protein), again most preferably so as to allow binding with increased avidity and also intramolecular binding and/or recognition.

Accordingly, also encompassed in the present invention is the use of a monovalent construct comprising an amino acid sequence of the invention (and in particular at least one NANOBODY® ($V_{HH}$ sequence)) that is directed against the 101F binding site on the RSV F protein (and in particular against antigenic site IV of the RSV F protein, and more in particular against the region aa 423-436 of the RSV F protein) and/or that is capable of competing with 101F for binding to the RSV F protein, and a monovalent construct comprising an amino acid of the invention (and in particular a NANOBODY® ($V_{HH}$ sequence)) that is directed against the Synagis® binding site on the RSV F protein (and in particular against antigenic site II of the RSV F protein, and more in particular against the region aa 250-275 of the RSV F protein) and/or that is capable of competing with Synagis® for binding to the RSV F protein, as binding domains or binding units in providing and/or preparing a biparatopic construct, wherein the binding domains or binding units are linked via a linker such that the biparatopic construct preferably exhibits intramolecular binding compared to intermolecular binding.

In some of the most preferred bivalent polypeptides of the invention, at least two monovalent constructs of the invention (and in particular at least two NANOBODIES® ($V_{HH}$ sequences)) are used that are directed against the Synagis® binding site on the RSV F protein (and in particular against antigenic site II of the RSV F protein, and more in particular against the region aa 250-275 of the RSV F protein) and/or that are capable of competing with Synagis® for binding to the RSV F protein. In such a preferred bivalent construct of the invention, the linker is most preferably such that the bivalent construct of the invention is capable of (simultaneously) binding to two Synagis® binding sites on the RSV F protein (and in particular against antigenic site II of the RSV F protein, and more in particular against the region aa 250-275 of the RSV F protein), again most preferably so as to allow binding with increased avidity and also intramolecular binding and/or recognition.

Accordingly, also encompassed in the present invention is the use of two monovalent constructs comprising an amino acid of the invention (and in particular a NANOBODY® ($V_{HH}$ sequence)) that is directed against the Synagis® binding site on the RSV F protein (and in particular against antigenic site II of the RSV F protein, and more in particular against the region aa 250-275 of the RSV F protein) and/or that is capable of competing with Synagis® for binding to the RSV F protein, as binding domains or binding units in providing and/or preparing a bivalent construct, wherein the binding domains or binding units are linked via a linker such that the bivalent construct preferably exhibits intramolecular binding compared to intermolecular binding.

In some of the most preferred bivalent polypeptides of the invention, at least two monovalent construct of the invention (and in particular at least two NANOBODIES® ($V_{HH}$ sequences)) are used that are directed against the 101F binding site on the RSV F protein (and in particular against antigenic site IV-VI of the RSV F protein, and more in particular against region aa 423-436 of the RSV F protein) and/or that are capable of competing with 101F for binding to the RSV F protein. In such a preferred bivalent construct of the invention, the linker is most preferably such that the bivalent construct of the invention is capable of (simultaneously) binding to two 101F binding sites on the RSV F protein (and in particular against antigenic site IV-VI of the RSV F protein, and more in particular against the region aa 423-436 of the RSV F protein), again most preferably so as to allow binding with increased avidity and also intramolecular binding and/or recognition.

Accordingly, also encompassed in the present invention is the use of two monovalent construct comprising an amino acid sequence of the invention (and in particular at least one NANOBODY® ($V_{HH}$ sequence)) that is directed against the 101F binding site on the RSV F protein (and in particular against antigenic site IV of the RSV F protein, and more in particular against the region aa 423-436 of the RSV F protein) and/or that is capable of competing with 101F for binding to the RSV F protein, as binding domains or binding units in providing and/or preparing a bivalent construct, wherein the binding domains or binding units are linked via a linker such that the bivalent construct preferably exhibits intramolecular binding compared to intermolecular binding.

In some of the most preferred trivalent polypeptides of the invention, at least one monovalent construct of the invention (and in particular at least one NANOBODY® ($V_{HH}$ sequence)) is used that is directed against the Synagis® binding site on the RSV F protein (and in particular against antigenic site II of the RSV F protein, and more in particular against region aa 250-275 of the RSV F protein) and/or that is capable of competing with Synagis® for binding to the RSV F protein.

In some of the most preferred trivalent (biparatopic or triparatopic) polypeptides of the invention, at least one monovalent construct of the invention (and in particular at least one NANOBODY® ($V_{HH}$ sequence)) is used that is directed against the Synagis® binding site on the RSV F protein (and in particular against antigenic site II of the RSV F protein, and more in particular against region aa 250-275 of the RSV F protein) and/or that is capable of competing with Synagis® for binding to the RSV F protein; and at least one amino acid sequence of the invention (and in particular at least one NANOBODY® ($V_{HH}$ sequence)) is used that is directed against another antigenic determinant, epitope, part or domain of the RSV F protein. In such a preferred trivalent (biparatopic or triparatopic) construct of the invention, the linker is most preferably such that the trivalent (biparatopic or triparatopic) binding site on the RSV F protein (and in particular against antigenic site II of the RSV F protein, and more in particular against the region aa 250-275 of the RSV F protein) as well as the other antigenic determinant, epitope, part or domain of the RSV F protein, again most preferably so as to allow binding with increased avidity and also intramolecular binding and/or recognition.

Accordingly, also encompassed in the present invention is the use of a monovalent construct comprising an amino acid of the invention (and in particular a NANOBODY® ($V_{HH}$ sequence)) that is directed against the Synagis® binding site on the RSV F protein (and in particular against antigenic site II of the RSV F protein, and more in particular against the region aa 250-275 of the RSV F protein) and/or that is capable of competing with Synagis® for binding to the RSV F protein, as a binding domain or binding unit in providing and/or preparing a trivalent, biparatopic or triparatopic construct, wherein the binding domains or binding units are linked via a linker such that the trivalent or triparatopic construct preferably exhibits intramolecular binding compared to intermolecular binding.

In some of the most preferred trivalent polypeptides of the invention, at least one monovalent construct of the invention (and in particular at least one NANOBODY® ($V_{HH}$ sequence)) is used that is directed against the 101F binding site on the RSV F protein (and in particular against antigenic site IV-VI of the RSV F protein, and more in particular against region aa 423-436 of the RSV F protein) and/or that is capable of competing with 101F for binding to the RSV F protein.

In some of the most preferred trivalent (biparatopic or triparatopic) polypeptides of the invention, at least one monovalent construct of the invention (and in particular at least one NANOBODY® ($V_{HH}$ sequence)) is used that is directed against the 101F binding site on the RSV F protein (and in particular against antigenic site IV-VI of the RSV F protein, and more in particular against region aa 423-436 of the RSV F protein) and/or that is capable of competing with 101F for binding to the RSV F protein; and at least one amino acid sequence of the invention (and in particular at least one NANOBODY® ($V_{HH}$ sequence)) is used that is directed against another antigenic determinant, epitope, part or domain of the RSV F protein. In such a preferred trivalent (biparatopic or triparatopic) construct of the invention, the linker is most preferably such that the trivalent (biparatopic or triparatopic) construct of the invention is capable of (simultaneously) binding to both the 101F binding site on the RSV F protein (and in particular against antigenic site IV-VI of the RSV F protein, and more in particular against the region aa 423-436 of the RSV F protein) as well as the other antigenic determinant, epitope, part or domain of the RSV F protein, again most preferably so as to allow binding with increased avidity and also intramolecular binding and/or recognition.

Accordingly, also encompassed in the present invention is the use of a monovalent construct comprising an amino acid of the invention (and in particular a NANOBODY® ($V_{HH}$ sequence)) that is directed against the 101F binding site on the RSV F protein (and in particular against antigenic site IV-VI of the RSV F protein, and more in particular against the region aa 423-436 of the RSV F protein) and/or that is capable of competing with 101F for binding to the RSV F protein, as a binding domain or binding unit in providing and/or preparing a trivalent, biparatopic or triparatopic construct, wherein the binding domains or binding units are linked via a linker such that the trivalent, biparatopic or triparatopic construct preferably exhibits intramolecular binding compared to intermolecular binding.

In some of the most preferred trivalent (biparatopic or triparatopic) polypeptides of the invention, at least one monovalent construct of the invention (and in particular at least one NANOBODY® ($V_{HH}$ sequence)) is used that is directed against the Synagis® binding site on the RSV F protein (and in particular against antigenic site II of the RSV F protein, and more in particular against the region aa 250-275 of the RSV F protein) and/or that is capable of competing with Synagis® for binding to the RSV F protein; and at least one monovalent construct of the invention (and in particular at least one NANOBODY® ($V_{HH}$ sequence)) is used that is directed against the 101F binding site on the RSV F protein (and in particular against antigenic site IV-VI of the RSV F protein, and more in particular against region aa 423-436 of the RSV F protein) and/or that is capable of competing with 101F for binding to the RSV F protein. In such a preferred trivalent (biparatopic or triparatopic) construct of the invention, the linker is most preferably such that the trivalent (biparatopic or triparatopic) construct of the invention is capable of (simultaneously) binding to both the Synagis® binding site on the RSV F protein (and in particular against antigenic site II of the RSV F protein, and more in particular against the region aa 250-275 of the RSV F protein) as well as the 101F binding site on the RSV F protein (and in particular against antigenic site IV-VI of the RSV F protein, and more in particular against the region aa 423-436 of the RSV F protein), again most preferably so as to allow binding with increased avidity and also intramolecular binding and/or recognition.

Accordingly, also encompassed in the present invention is the use of a monovalent construct comprising an amino acid sequence of the invention (and in particular at least one NANOBODY® ($V_{HH}$ sequence)) that is directed against the 101F binding site on the RSV F protein (and in particular against antigenic site IV of the RSV F protein, and more in particular against the region aa 423-436 of the RSV F protein) and/or that is capable of competing with 101F for binding to the RSV F protein, and a monovalent construct comprising an amino acid of the invention (and in particular a NANOBODY® ($V_{HH}$ sequence)) that is directed against the Synagis® binding site on the RSV F protein (and in particular against antigenic site II of the RSV F protein, and more in particular against the region aa 250-275 of the RSV F protein) and/or that is capable of competing with Synagis® for binding to the RSV F protein, as binding domains or binding units in providing and/or preparing a trivalent (biparatopic or triparatopic) construct, wherein the binding domains or binding units are linked via a linker such that the trivalent (biparatopic or triparatopic) construct preferably exhibits intramolecular binding compared to intermolecular binding.

In some of the most preferred trivalent polypeptides of the invention, at least three monovalent constructs of the invention (and in particular at least three NANOBODIES® ($V_{HH}$ sequences)) are used that are directed against the Synagis® binding site on the RSV F protein (and in particular against antigenic site II of the RSV F protein, and more in particular against the region aa 250-275 of the RSV F protein) and/or that are capable of competing with Synagis® for binding to the RSV F protein. In such a preferred trivalent construct of the invention, the linker is most preferably such that the trivalent construct of the invention is capable of (simultaneously) binding to three Synagis® binding sites on the RSV F protein (and in particular against antigenic site II of the RSV F protein, and more in particular against the region aa 250-275 of the RSV F protein), again most preferably so as to allow binding with increased avidity and also intramolecular binding and/or recognition.

Accordingly, also encompassed in the present invention is the use of three monovalent construct comprising an amino acid sequence of the invention (and in particular at least one NANOBODY® ($V_{HH}$ sequence)) that is directed against the Synagis® binding site on the RSV F protein (and in particular against antigenic site II of the RSV F protein, and more in particular against the region aa 250-275 of the RSV F protein) and/or that is capable of competing with Synagis® for binding to the RSV F protein, as binding domains or binding units in providing and/or preparing a trivalent construct, wherein the binding domains or binding units are linked via a linker such that the trivalent construct preferably exhibits intramolecular binding compared to intermolecular binding.

In some of the most preferred trivalent polypeptides of the invention, at least three monovalent constructs of the invention (and in particular at least three NANOBODIES® ($V_{HH}$ sequences)) are used that are directed against the 101F binding site on the RSV F protein (and in particular against antigenic site IV-VI of the RSV F protein, and more in particular against region aa 423-436 of the RSV F protein) and/or that are capable of competing with 101F for binding to the RSV F protein. In such a preferred trivalent construct of the invention, the linker is most preferably such that the trivalent construct of the invention is capable of (simultaneously) binding to three 101F binding sites on the RSV F protein (and in particular against antigenic site IV-VI of the RSV F protein, and more in particular against region aa 423-436 of the RSV F protein), again most preferably so as to allow binding with increased avidity and also intramolecular binding and/or recognition.

Accordingly, also encompassed in the present invention is the use of three monovalent construct comprising an amino acid sequence of the invention (and in particular at least one NANOBODY® ($V_{HH}$ sequence)) that is directed against the 101F binding site on the RSV F protein (and in particular against antigenic site IV of the RSV F protein, and more in particular against the region aa 423-436 of the RSV F protein) and/or that is capable of competing with 101F for binding to the RSV F protein, as binding domains or binding units in providing and/or preparing a trivalent construct, wherein the binding domains or binding units are linked via a linker such that the trivalent construct preferably exhibits intramolecular binding compared to intermolecular binding.

In another aspect, the invention relates to multivalent polypeptides directed against the hemagglutinin H5 envelope protein of influenza virus, in which at least one monovalent construct of the invention (and in particular at least one NANOBODY® ($V_{HH}$ sequence)) is used that is directed against the sialic acid binding site on the hemagglutinin H5 envelope protein of influenza virus and/or that is capable of competing with sialic acid for binding to the hemagglutinin H5 envelope protein of influenza virus.

In another aspect, the invention relates to multivalent polypeptides directed against the hemagglutinin H5 envelope protein of influenza virus, in which at least one monovalent construct of the invention (and in particular at least one NANOBODY® ($V_{HH}$ sequence)) is used that is directed against the sialic acid binding site on the hemagglutinin H5 envelope protein of influenza virus and/or that is capable of competing with sialic acid for binding to the hemagglutinin H5 envelope protein of influenza virus; and at least one amino acid sequence of the invention (and in particular at least one NANOBODY® ($V_{HH}$ sequence)) is used that is directed against another antigenic determinant, epitope, part or domain of the hemagglutinin H5 envelope protein of influenza virus. In such a preferred multiparatopic construct of the invention, the linker is most preferably such that the multiparatopic construct of the invention is capable of (simultaneously) binding to both the sialic acid binding site on the hemagglutinin H5 envelope protein of influenza virus as well as the other antigenic determinant, epitope, part or domain of the hemagglutinin H5 envelope protein of influenza virus, again most preferably so as to allow binding with increased avidity and also intramolecular binding and/or recognition.

Accordingly, also encompassed in the present invention is the use of a monovalent construct comprising an amino acid of the invention (and in particular a NANOBODY® ($V_{HH}$ sequence)) that is directed against the sialic acid binding site on the hemagglutinin H5 envelope protein of influenza virus and/or that is capable of competing with sialic acid for binding to the hemagglutinin H5 envelope protein of influenza virus, as a binding domain or binding unit in providing and/or preparing a multivalent or multiparatopic (such as multispecific, multiparatopic, and preferably trivalent, bivalent, triparatopic, biparatopic, trispecific, bispecific, etc.) construct, wherein the binding domains or binding units are linked via a linker such that the multivalent or multiparatopic (such as multispecific, multiparatopic, and preferably trivalent, bivalent, triparatopic, biparatopic, trispecific, bispecific, etc.) construct preferably exhibits intramolecular binding compared to intermolecular binding.

In yet another aspect, the invention relates to multivalent polypeptides directed against the hemagglutinin H5 envelope protein of influenza virus, in which at least one monovalent construct of the invention (and in particular at least one NANOBODY® ($V_{HH}$ sequence)) is used that is directed against the VN04-2 binding site on the hemagglutinin H5 envelope protein of influenza virus and/or that is capable of competing with VN04-2 for binding to the hemagglutinin H5 envelope protein of influenza virus.

In yet another aspect, the invention relates to multivalent polypeptides directed against the hemagglutinin H5 envelope protein of influenza virus, in which at least one monovalent construct of the invention (and in particular at least one NANOBODY® ($V_{HH}$ sequence)) is used that is directed against the VN04-2 binding site on the hemagglutinin H5 envelope protein of influenza virus and/or that is capable of competing with VN04-2 for binding to the hemagglutinin H5 envelope protein of influenza virus; and at least one amino acid sequence of the invention (and in particular at least one NANOBODY® ($V_{HH}$ sequence)) is used that is directed against another antigenic determinant, epitope, part or domain of the hemagglutinin H5 envelope protein of influenza virus. In such a preferred multiparatopic construct of the invention, the linker is most preferably such that the multiparatopic construct of the invention is capable of (simultaneously) binding to both the VN04-2 binding site on the hemagglutinin H5 envelope protein of influenza virus as well as the other antigenic determinant, epitope, part or domain of the hemagglutinin H5 envelope protein of influenza virus, again most preferably so as to allow binding with increased avidity and also intramolecular binding and/or recognition.

Accordingly, also encompassed in the present invention is the use of a monovalent construct comprising an amino acid of the invention (and in particular a NANOBODY® ($V_{HH}$ sequence)) that is directed against the VN04-2 binding site on the hemagglutinin H5 envelope protein of influenza virus and/or that is capable of competing with VN04-2 for binding to the hemagglutinin H5 envelope protein of influenza virus, as a binding domain or binding unit in providing and/or preparing a multivalent or multiparatopic (such as multispecific, multiparatopic, and preferably trivalent, bivalent, triparatopic, biparatopic, trispecific, bispecific, etc.) construct, wherein the binding domains or binding units are linked via a linker such that the multivalent or multiparatopic (such as multispecific, multiparatopic, and preferably trivalent, bivalent, triparatopic, biparatopic, trispecific, bispecific, etc.) construct preferably exhibits intramolecular binding compared to intermolecular binding.

In yet another aspect, the invention relates to multivalent polypeptides directed against the hemagglutinin H5 envelope protein of influenza virus, in which at least one monovalent construct of the invention (and in particular at least one NANOBODY® ($V_{HH}$ sequence)) is used that is directed against the MAb C179 binding site on the hemagglutinin H5 envelope protein of influenza virus and/or that is capable of competing with MAb C179 for binding to the hemagglutinin H5 envelope protein of influenza virus.

In yet another aspect, the invention relates to multivalent polypeptides directed against the hemagglutinin H5 envelope protein of influenza virus, in which at least one monovalent construct of the invention (and in particular at least one NANOBODY® ($V_{HH}$ sequence)) is used that is directed against the MAb C179 binding site on the hemagglutinin H5 envelope protein of influenza virus and/or that is capable of competing with MAb C1792 for binding to the hemagglutinin H5 envelope protein of influenza virus; and at least one amino acid sequence of the invention (and in particular at least one NANOBODY® ($V_{HH}$ sequence)) is used that is directed against another antigenic determinant, epitope, part or domain of the hemagglutinin H5 envelope protein of influenza virus. In such a preferred multiparatopic construct of the invention, the linker is most preferably such that the multiparatopic construct of the invention is capable of (simultaneously) binding to both the MAb C179 binding site on the hemagglutinin H5 envelope protein of influenza virus as well as the other antigenic determinant, epitope, part or domain of the hemagglutinin H5 envelope protein of influenza virus, again most preferably so as to allow binding with increased avidity and also intramolecular binding and/or recognition.

Accordingly, also encompassed in the present invention is the use of a monovalent construct comprising an amino acid of the invention (and in particular a NANOBODY® ($V_{HH}$ sequence)) that is directed against the MAb C179 binding site on the hemagglutinin H5 envelope protein of influenza virus and/or that is capable of competing with MAb C179 for binding to the hemagglutinin H5 envelope protein of influenza virus, as a binding domain or binding unit in providing and/or preparing a multivalent or multiparatopic (such as multispecific, multiparatopic, and preferably trivalent, bivalent, triparatopic, biparatopic, trispecific, bispecific, etc.) construct, wherein the binding domains or binding units are linked via a linker such that the multivalent or multiparatopic (such as multispecific, multiparatopic, and preferably trivalent, bivalent, triparatopic, biparatopic, trispecific, bispecific, etc.) construct preferably exhibits intramolecular binding compared to intermolecular binding.

In some of the most preferred biparatopic polypeptides of the invention, at least one monovalent construct of the invention (and in particular at least one NANOBODY® ($V_{HH}$ sequence)) is used that is directed against the sialic acid binding site on the hemagglutinin H5 envelope protein of influenza virus and/or that is capable of competing with sialic acid for binding to the hemagglutinin H5 envelope protein of influenza virus; and at least one amino acid sequence of the invention (and in particular at least one NANOBODY® ($V_{HH}$ sequence)) is used that is directed against another antigenic determinant, epitope, part or domain of the hemagglutinin H5 envelope protein of influenza virus. In such a preferred biparatopic construct of the invention, the linker is most preferably such that the biparatopic construct of the invention is capable of (simultaneously) binding to both the sialic acid binding site on the hemagglutinin H5 envelope protein of influenza virus as well as the other antigenic determinant, epitope, part or domain of the hemagglutinin H5 envelope protein of influenza virus, again most preferably so as to allow binding with increased avidity and also intramolecular binding and/or recognition.

Accordingly, also encompassed in the present invention is the use of a monovalent construct comprising an amino acid of the invention (and in particular a NANOBODY® ($V_{HH}$ sequence)) that is directed against the sialic acid binding site on the hemagglutinin H5 envelope protein of influenza virus and/or that is capable of competing with sialic acid for binding to the hemagglutinin H5 envelope protein of influenza virus, as a binding domain or binding unit in providing and/or preparing a biparatopic construct, wherein the binding domains or binding units are linked via a linker such that the biparatopic construct preferably exhibits intramolecular binding compared to intermolecular binding.

In some of the most preferred biparatopic polypeptides of the invention, at least one monovalent construct of the invention (and in particular at least one NANOBODY® ($V_{HH}$ sequence)) is used that is directed against the VN04-2 binding site on the hemagglutinin H5 envelope protein of influenza virus and/or that is capable of competing with VN04-2 for binding to the hemagglutinin H5 envelope protein of influenza virus; and at least one amino acid sequence of the invention (and in particular at least one NANOBODY® ($V_{HH}$ sequence)) is used that is directed against another antigenic determinant, epitope, part or domain of the hemagglutinin H5 envelope protein of influenza virus. In such a preferred biparatopic construct of the invention, the linker is most preferably such that the biparatopic construct of the invention is capable of (simultaneously) binding to both the VN04-2 binding site on the hemagglutinin H5 envelope protein of influenza virus as well as the other antigenic determinant, epitope, part or domain of the hemagglutinin H5 envelope protein of influenza virus, again most preferably so as to allow binding with increased avidity and also intramolecular binding and/or recognition.

Accordingly, also encompassed in the present invention is the use of a monovalent construct comprising an amino acid of the invention (and in particular a NANOBODY® ($V_{HH}$ sequence)) that is directed against the VN04-2 binding site on the hemagglutinin H5 envelope protein of influenza virus and/or that is capable of competing with VN04-2 for binding to the hemagglutinin H5 envelope protein of influenza virus, as a binding domain or binding unit in providing and/or preparing a biparatopic construct, wherein the binding domains or binding units are linked via a linker such that the biparatopic construct preferably exhibits intramolecular binding compared to intermolecular binding.

In some of the most preferred biparatopic polypeptides of the invention, at least one monovalent construct of the invention (and in particular at least one NANOBODY® ($V_{HH}$ sequence)) is used that is directed against the MAb C179 binding site on the hemagglutinin H5 envelope protein of influenza virus and/or that is capable of competing with MAb C179 for binding to the hemagglutinin H5 envelope protein of influenza virus; and at least one amino acid sequence of the invention (and in particular at least one NANOBODY® ($V_{HH}$ sequence)) is used that is directed against another antigenic determinant, epitope, part or domain of the hemagglutinin H5 envelope protein of influenza virus. In such a preferred biparatopic construct of the invention, the linker is most preferably such that the biparatopic construct of the invention is capable of (simultaneously) binding to both the MAb C179 binding site on the hemagglutinin H5 envelope protein of influenza virus as well as the other antigenic determinant, epitope, part or domain of the hemagglutinin H5 envelope protein of influenza virus, again most preferably so as to allow binding with increased avidity and also intramolecular binding and/or recognition.

Accordingly, also encompassed in the present invention is the use of a monovalent construct comprising an amino acid of the invention (and in particular a NANOBODY® ($V_{HH}$ sequence)) that is directed against the MAb C179 binding site on the hemagglutinin H5 envelope protein of influenza virus and/or that is capable of competing with MAb C179 for binding to the hemagglutinin H5 envelope protein of influenza virus, as a binding domain or binding unit in providing and/or preparing a biparatopic construct, wherein the binding domains or binding units are linked via a linker such that the biparatopic construct preferably exhibits intramolecular binding compared to intermolecular binding.

In some of the most preferred bivalent polypeptides of the invention, at least two monovalent constructs of the invention (and in particular at least two NANOBODIES® ($V_{HH}$ sequences)) are used that are directed against the sialic acid binding site on the hemagglutinin H5 envelope protein of influenza virus and/or that are capable of competing with sialic acid for binding to the hemagglutinin H5 envelope protein of influenza virus. In such a preferred bivalent construct of the invention, the linker is most preferably such that the bivalent construct of the invention is capable of (simultaneously) binding to two sialic acid binding sites on the hemagglutinin H5 envelope protein of influenza virus, again most preferably so as to allow binding with increased avidity and also intramolecular binding and/or recognition.

Accordingly, also encompassed in the present invention is the use of two monovalent constructs comprising an amino acid of the invention (and in particular a NANOBODY® ($V_{HH}$ sequence)) that is directed against the sialic acid binding site on the hemagglutinin H5 envelope protein of influenza virus and/or that is capable of competing with sialic acid for binding to the hemagglutinin H5 envelope protein of influenza virus, as binding domains or binding units in providing and/or preparing a bivalent construct, wherein the binding domains or binding units are linked via a linker such that the bivalent construct preferably exhibits intramolecular binding compared to intermolecular binding.

In some of the most preferred bivalent polypeptides of the invention, at least two monovalent construct of the invention (and in particular at least two NANOBODIES® ($V_{HH}$ sequences)) are used that are directed against the VN04-2 binding site on the hemagglutinin H5 envelope protein of influenza virus and/or that are capable of competing with VN04-2 for binding to the hemagglutinin H5 envelope protein of influenza virus. In such a preferred bivalent construct of the invention, the linker is most preferably such that the bivalent construct of the invention is capable of (simultaneously) binding to two VN04-2 binding sites on the hemagglutinin H5 envelope protein of influenza virus, again most preferably so as to allow binding with increased avidity and also intramolecular binding and/or recognition. Accordingly, also encompassed in the present invention is the use of two monovalent construct comprising an amino acid sequence of the invention (and in particular at least one NANOBODY® ($V_{HH}$ sequence)) that is directed against the VN04-2 binding site on the hemagglutinin H5 envelope protein of influenza virus and/or that is capable of competing with VN04-2 for binding to the hemagglutinin H5 envelope protein of influenza virus, as binding domains or binding units in providing and/or preparing a bivalent construct, wherein the binding domains or binding units are linked via a linker such that the bivalent construct preferably exhibits intramolecular binding compared to intermolecular binding.

In some of the most preferred bivalent polypeptides of the invention, at least two monovalent construct of the invention (and in particular at least two NANOBODIES® ($V_{HH}$ sequences)) are used that are directed against the MAb C179 binding site on the hemagglutinin H5 envelope protein of influenza virus and/or that are capable of competing with MAb C179 for binding to the hemagglutinin H5 envelope protein of influenza virus. In such a preferred bivalent construct of the invention, the linker is most preferably such that the bivalent construct of the invention is capable of (simultaneously) binding to two MAb C179 binding sites on the hemagglutinin H5 envelope protein of influenza virus, again most preferably so as to allow binding with increased avidity and also intramolecular binding and/or recognition.

Accordingly, also encompassed in the present invention is the use of two monovalent construct comprising an amino acid sequence of the invention (and in particular at least one NANOBODY® ($V_{HH}$ sequence)) that is directed against the MAb C179 binding site on the hemagglutinin H5 envelope protein of influenza virus and/or that is capable of competing with MAb C179 for binding to the hemagglutinin H5 envelope protein of influenza virus, as binding domains or binding units in providing and/or preparing a bivalent construct, wherein the binding domains or binding units are linked via a linker such that the bivalent construct preferably exhibits intramolecular binding compared to intermolecular binding.

In some of the most preferred trivalent polypeptides of the invention, at least one monovalent construct of the invention (and in particular at least one NANOBODY® ($V_{HH}$ sequence)) is used that is directed against the sialic acid binding site on the hemagglutinin H5 envelope protein of influenza virus and/or that is capable of competing with sialic acid for binding to the hemagglutinin H5 envelope protein of influenza virus.

In some of the most preferred trivalent (biparatopic or triparatopic) polypeptides of the invention, at least one monovalent construct of the invention (and in particular at least one NANOBODY® ($V_{HH}$ sequence)) is used that is directed against the sialic acid binding site on the hemagglutinin H5 envelope protein of influenza virus and/or that is capable of competing with sialic acid for binding to the hemagglutinin H5 envelope protein of influenza virus; and at least one amino acid sequence of the invention (and in particular at least one NANOBODY® ($V_{HH}$ sequence)) is used that is directed against another antigenic determinant, epitope, part or domain of the hemagglutinin H5 envelope protein of influenza virus. In such a preferred trivalent (biparatopic or triparatopic) construct of the invention, the linker is most preferably such that the trivalent (biparatopic or triparatopic) construct of the invention is capable of (simultaneously) binding to the sialic acid binding site on the hemagglutinin H5 envelope protein of influenza virus as well as the other antigenic determinant, epitope, part or domain of the hemagglutinin H5 envelope protein of influenza virus, again most preferably so as to allow binding with increased avidity and also intramolecular binding and/or recognition.

Accordingly, also encompassed in the present invention is the use of a monovalent construct comprising an amino acid of the invention (and in particular a NANOBODY® ($V_{HH}$ sequence)) that is directed against the sialic acid binding site on the hemagglutinin H5 envelope protein of influenza virus and/or that is capable of competing with sialic acid for binding to the hemagglutinin H5 envelope protein of influenza virus, as a binding domain or binding unit in providing and/or preparing a trivalent, biparatopic or triparatopic construct, wherein the binding domains or binding units are linked via a linker such that the trivalent or triparatopic construct preferably exhibits intramolecular binding compared to intermolecular binding.

In some of the most preferred trivalent polypeptides of the invention, at least one monovalent construct of the invention (and in particular at least one NANOBODY® ($V_{HH}$ sequence)) is used that is directed against the VN04-2 binding site on the hemagglutinin H5 envelope protein of influenza virus and/or that is capable of competing with VN04-2 for binding to the hemagglutinin H5 envelope protein of influenza virus.

In some of the most preferred trivalent (biparatopic or triparatopic) polypeptides of the invention, at least one monovalent construct of the invention (and in particular at least one NANOBODY® ($V_{HH}$ sequence)) is used that is directed against the VN04-2 binding site on the hemagglutinin H5 envelope protein of influenza virus and/or that is capable of competing with VN04-2 for binding to the hemagglutinin H5 envelope protein of influenza virus; and at least one amino acid sequence of the invention (and in particular at least one NANOBODY® ($V_{HH}$ sequence)) is used that is directed against another antigenic determinant, epitope, part or domain of the hemagglutinin H5 envelope protein of influenza virus. In such a preferred trivalent (biparatopic or triparatopic) construct of the invention, the linker is most preferably such that the trivalent (biparatopic or triparatopic) construct of the invention is capable of (simultaneously) binding to both the VN04-2 binding site on the hemagglutinin H5 envelope protein of influenza virus as well as the other antigenic determinant, epitope, part or domain of the hemagglutinin H5 envelope protein of influenza virus, again most preferably so as to allow binding with increased avidity and also intramolecular binding and/or recognition.

Accordingly, also encompassed in the present invention is the use of a monovalent construct comprising an amino acid of the invention (and in particular a NANOBODY® ($V_{HH}$ sequence)) that is directed against the VN04-2 binding site on the hemagglutinin H5 envelope protein of influenza virus and/or that is capable of competing with VN04-2 for binding to the hemagglutinin H5 envelope protein of influenza virus, as a binding domain or binding unit in providing and/or preparing a trivalent, biparatopic or triparatopic construct, wherein the binding domains or binding units are linked via a linker such that the trivalent, biparatopic or triparatopic construct preferably exhibits intramolecular binding compared to intermolecular binding.

In some of the most preferred trivalent polypeptides of the invention, at least one monovalent construct of the invention (and in particular at least one NANOBODY® ($V_{HH}$ sequence)) is used that is directed against the MAb C179 binding site on the hemagglutinin H5 envelope protein of influenza virus and/or that is capable of competing with MAb C179 for binding to the hemagglutinin H5 envelope protein of influenza virus.

In some of the most preferred trivalent (biparatopic or triparatopic) polypeptides of the invention, at least one monovalent construct of the invention (and in particular at least one NANOBODY® ($V_{HH}$ sequence)) is used that is directed against the MAb C179 binding site on the hemagglutinin H5 envelope protein of influenza virus and/or that is capable of competing with MAb C179 for binding to the hemagglutinin H5 envelope protein of influenza virus; and at least one amino acid sequence of the invention (and in particular at least one NANOBODY® ($V_{HH}$ sequence)) is used that is directed against another antigenic determinant, epitope, part or domain of the hemagglutinin H5 envelope protein of influenza virus. In such a preferred trivalent (biparatopic or triparatopic) construct of the invention, the linker is most preferably such that the trivalent (biparatopic or triparatopic) construct of the invention is capable of (simultaneously) binding to both the MAb C179 binding site on the hemagglutinin H5 envelope protein of influenza virus as well as the other antigenic determinant, epitope, part or domain of the hemagglutinin H5 envelope protein of influenza virus, again most preferably so as to allow binding with increased avidity and also intramolecular binding and/or recognition.

Accordingly, also encompassed in the present invention is the use of a monovalent construct comprising an amino acid of the invention (and in particular a NANOBODY® ($V_{HH}$ sequence)) that is directed against the MAb C179 binding site on the hemagglutinin H5 envelope protein of influenza virus and/or that is capable of competing with MAb C179 for binding to the hemagglutinin H5 envelope protein of influenza virus, as a binding domain or binding unit in providing and/or preparing a trivalent, biparatopic or triparatopic construct, wherein the binding domains or binding units are linked via a linker such that the trivalent, biparatopic or triparatopic construct preferably exhibits intramolecular binding compared to intermolecular binding.

In some of the most preferred trivalent polypeptides of the invention, at least three monovalent constructs of the invention (and in particular at least three NANOBODIES® ($V_{HH}$ sequences)) are used that are directed against the sialic acid binding site on the hemagglutinin H5 envelope protein of influenza virus and/or that are capable of competing with sialic acid for binding to the hemagglutinin H5 envelope protein of influenza virus. In such a preferred trivalent construct of the invention, the linker is most preferably such that the trivalent construct of the invention is capable of (simultaneously) binding to three sialic acid binding sites on the hemagglutinin H5 envelope protein of influenza virus, again most preferably so as to allow binding with increased avidity and also intramolecular binding and/or recognition.

Accordingly, also encompassed in the present invention is the use of three monovalent construct comprising an amino acid sequence of the invention (and in particular at least one NANOBODY® ($V_{HH}$ sequence)) that is directed against the sialic acid binding site on the hemagglutinin H5 envelope protein of influenza virus and/or that is capable of competing with sialic acid for binding to the hemagglutinin H5 envelope protein of influenza virus, as binding domains or binding units in providing and/or preparing a trivalent construct, wherein the binding domains or binding units are linked via a linker such that the trivalent construct preferably exhibits intramolecular binding compared to intermolecular binding.

In some of the most preferred trivalent polypeptides of the invention, at least three monovalent constructs of the invention (and in particular at least three NANOBODIES® ($V_{HH}$ sequences)) are used that are directed against the VN04-2 binding site on the hemagglutinin H5 envelope protein of influenza virus and/or that are capable of competing with VN04-2 for binding to the hemagglutinin H5 envelope protein of influenza virus. In such a preferred trivalent construct of the invention, the linker is most preferably such that the trivalent construct of the invention is capable of (simultaneously) binding to three VN04-2 binding sites on the hemagglutinin H5 envelope protein of influenza virus, again most preferably so as to allow binding with increased avidity and also intramolecular binding and/or recognition.

Accordingly, also encompassed in the present invention is the use of three monovalent construct comprising an amino acid sequence of the invention (and in particular at least one NANOBODY® ($V_{HH}$ sequence)) that is directed against the VN04-2 binding site on the hemagglutinin H5 envelope protein of influenza virus and/or that is capable of competing with VN04-2 for binding to the hemagglutinin H5 envelope protein of influenza virus, as binding domains or binding units in providing and/or preparing a trivalent construct, wherein the binding domains or binding units are linked via a linker such that the trivalent construct preferably exhibits intramolecular binding compared to intermolecular binding.

In some of the most preferred trivalent polypeptides of the invention, at least three monovalent constructs of the invention (and in particular at least three NANOBODIES® ($V_{HH}$ sequences)) are used that are directed against the MAb C179 binding site on the hemagglutinin H5 envelope protein of influenza virus and/or that are capable of competing with MAb C179 for binding to the hemagglutinin H5 envelope protein of influenza virus. In such a preferred trivalent construct of the invention, the linker is most preferably such that the trivalent construct of the invention is capable of (simultaneously) binding to three MAb C179 binding sites on the hemagglutinin H5 envelope protein of influenza virus, again most preferably so as to allow binding with increased avidity and also intramolecular binding and/or recognition.

Accordingly, also encompassed in the present invention is the use of three monovalent construct comprising an amino acid sequence of the invention (and in particular at least one NANOBODY® ($V_{HH}$ sequence)) that is directed against the MAb C179 binding site on the hemagglutinin H5 envelope protein of influenza virus and/or that is capable of competing with MAb C179 for binding to the hemagglutinin H5 envelope protein of influenza virus, as binding domains or binding units in providing and/or preparing a trivalent construct, wherein the binding domains or binding units are linked via a linker such that the trivalent construct preferably exhibits intramolecular binding compared to intermolecular binding.

In another aspect, the invention relates to multivalent polypeptides directed against the G envelope protein of rabies virus, in which at least one monovalent construct of the invention (and in particular at least one NANOBODY® ($V_{HH}$ sequence)) is used that is directed against the MAb 8-2 binding site on the G envelope protein of rabies virus and/or that is capable of competing with MAb 8-2 for binding to the G envelope protein of rabies virus.

In another aspect, the invention relates to multivalent polypeptides directed against the G envelope protein of rabies virus, in which at least one monovalent construct of the invention (and in particular at least one NANOBODY® ($V_{HH}$ sequence)) is used that is directed against the MAb 8-2 binding site on the G envelope protein of rabies virus and/or that is capable of competing with MAb 8-2 for binding to the G envelope protein of rabies virus; and at least one amino acid sequence of the invention (and in particular at least one NANOBODY® ($V_{HH}$ sequence)) is used that is directed against another antigenic determinant, epitope, part or domain of the G envelope protein of rabies virus. In such a preferred multiparatopic construct of the invention, the linker is most preferably such that the multiparatopic construct of the invention is capable of (simultaneously) binding to both the MAb 8-2 binding site on the G envelope protein of rabies virus as well as the other antigenic determinant, epitope, part or domain of the G envelope protein of rabies virus, again most preferably so as to allow binding with increased avidity and also intramolecular binding and/or recognition.

Accordingly, also encompassed in the present invention is the use of a monovalent construct comprising an amino acid of the invention (and in particular a NANOBODY® ($V_{HH}$ sequence)) that is directed against the MAb 8-2 binding site on the G envelope protein of rabies virus and/or that is capable of competing with MAb 8-2 for binding to the G envelope protein of rabies virus, as a binding domain or binding unit in providing and/or preparing a multivalent or multiparatopic (such as multispecific, multiparatopic, and preferably trivalent, bivalent, triparatopic, biparatopic, trispecific, bispecific, etc.) construct, wherein the binding domains or binding units are linked via a linker such that the multivalent or multiparatopic (such as multispecific, multiparatopic, and preferably trivalent, bivalent, triparatopic, biparatopic, trispecific, bispecific, etc.) construct preferably exhibits intramolecular binding compared to intermolecular binding.

In some of the most preferred biparatopic polypeptides of the invention, at least one monovalent construct of the invention (and in particular at least one NANOBODY® ($V_{HH}$ sequence)) is used that is directed against the MAb 8-2 binding site on the G envelope protein of rabies virus and/or that is capable of competing with MAb 8-2 for binding to the G envelope protein of rabies virus; and at least one amino acid sequence of the invention (and in particular at least one NANOBODY® ($V_{HH}$ sequence)) is used that is directed against another antigenic determinant, epitope, part or domain of the G envelope protein of rabies virus. In such a preferred biparatopic construct of the invention, the linker is most preferably such that the biparatopic construct of the invention is capable of (simultaneously) binding to both the MAb 8-2 binding site on the G envelope protein of rabies virus as well as the other antigenic determinant, epitope, part or domain of the G envelope protein of rabies virus, again most preferably so as to allow binding with increased avidity and also intramolecular binding and/or recognition.

Accordingly, also encompassed in the present invention is the use of a monovalent construct comprising an amino acid of the invention (and in particular a NANOBODY® ($V_{HH}$ sequence)) that is directed against the MAb 8-2 binding site on the G envelope protein of rabies virus and/or that is capable of competing with MAb 8-2 for binding to the G envelope protein of rabies virus, as a binding domain or binding unit in providing and/or preparing a biparatopic construct, wherein the binding domains or binding units are linked via a linker such that the biparatopic construct preferably exhibits intramolecular binding compared to intermolecular binding.

In some of the most preferred bivalent polypeptides of the invention, at least two monovalent constructs of the invention (and in particular at least two NANOBODIES® ($V_{HH}$ sequences)) are used that are directed against the MAb 8-2 binding site on the G envelope protein of rabies virus and/or that are capable of competing with MAb 8-2 for binding to the G envelope protein of rabies virus. In such a preferred bivalent construct of the invention, the linker is most preferably such that the bivalent construct of the invention is capable of (simultaneously) binding to two MAb 8-2 binding sites on the G envelope protein of rabies virus, again most preferably so as to allow binding with increased avidity and also intramolecular binding and/or recognition.

Accordingly, also encompassed in the present invention is the use of two monovalent constructs comprising an amino acid of the invention (and in particular a NANOBODY® ($V_{HH}$ sequence)) that is directed against the MAb 8-2 binding site on the G envelope protein of rabies virus and/or that is capable of competing with MAb 8-2 for binding to the G envelope protein of rabies virus, as binding domains or binding units in providing and/or preparing a bivalent construct, wherein the binding domains or binding units are linked via a linker such that the bivalent construct preferably exhibits intramolecular binding compared to intermolecular binding.

In some of the most preferred trivalent polypeptides of the invention, at least one monovalent construct of the invention (and in particular at least one NANOBODY® ($V_{HH}$ sequence)) is used that is directed against the MAb 8-2 binding site on the G envelope protein of rabies virus and/or that is capable of competing with MAb 8-2 for binding to the G envelope protein of rabies virus.

In some of the most preferred trivalent (biparatopic or triparatopic) polypeptides of the invention, at least one monovalent construct of the invention (and in particular at least one NANOBODY® ($V_{HH}$ sequence)) is used that is directed against the MAb 8-2 binding site on the G envelope protein of rabies virus and/or that is capable of competing with MAb 8-2 for binding to the G envelope protein of rabies virus; and at least one amino acid sequence of the invention (and in particular at least one NANOBODY® ($V_{HH}$ sequence)) is used that is directed against another antigenic determinant, epitope, part or domain of the G envelope protein of rabies virus. In such a preferred trivalent (biparatopic or triparatopic) construct of the invention, the linker is most preferably such that the trivalent (biparatopic or triparatopic) construct of the invention is capable of (simultaneously) binding to the MAb 8-2 binding sites on the G envelope protein of rabies virus as well as the other antigenic determinant, epitope, part or domain of the G envelope protein of rabies virus, again most preferably so as to allow binding with increased avidity and also intramolecular binding and/or recognition.

Accordingly, also encompassed in the present invention is the use of a monovalent construct comprising an amino acid of the invention (and in particular a NANOBODY® ($V_{HH}$ sequence)) that is directed against the MAb 8-2 binding site on the G envelope protein of rabies virus and/or that is capable of competing with MAb 8-2 for binding to the G envelope protein of rabies virus, as a binding domain or binding unit in providing and/or preparing a trivalent, biparatopic or tri-paratopic construct, wherein the binding domains or binding units are linked via a linker such that the trivalent or tri-paratopic construct preferably exhibits intramolecular binding compared to intermolecular binding.

In some of the most preferred trivalent polypeptides of the invention, at least three monovalent constructs of the invention (and in particular at least three NANOBODIES® ($V_{HH}$ sequences)) are used that are directed against the MAb 8-2 binding site on the G envelope protein of rabies virus and/or that are capable of competing with MAb 8-2 for binding to the G envelope protein of rabies virus. In such a preferred trivalent construct of the invention, the linker is most preferably such that the trivalent construct of the invention is capable of (simultaneously) binding to three MAb 8-2 binding sites on the G envelope protein of rabies virus, again most preferably so as to allow binding with increased avidity and also intramolecular binding and/or recognition.

Accordingly, also encompassed in the present invention is the use of three monovalent construct comprising an amino acid sequence of the invention (and in particular at least one NANOBODY® ($V_{HH}$ sequence)) that is directed against the MAb 8-2 binding site on the G envelope protein of rabies virus and/or that is capable of competing with MAb 8-2 for binding to the G envelope protein of rabies virus, as binding domains or binding units in providing and/or preparing a trivalent construct, wherein the binding domains or binding units are linked via a linker such that the trivalent construct preferably exhibits intramolecular binding compared to intermolecular binding.

The invention further relates to applications and uses of the amino acid sequences, compounds, constructs, polypeptides, nucleic acids, host cells, products and compositions described herein, as well as to methods for the prevention and/or treatment for diseases and disorders associated with viral entry and/or viral replication and/or mediated by an envelope protein of a virus and/or its viral receptor. Some preferred but non-limiting applications and uses will become clear from the further description herein.

The invention also relates to the amino acid sequences, compounds, constructs, polypeptides, nucleic acids, host cells, products and compositions described herein for use in therapy.

In particular, the invention also relates to the amino acid sequences, compounds, constructs, polypeptides, nucleic acids, host cells, products and compositions described herein for use in therapy of a disease or disorder that can be prevented or treated by administering, to a subject in need thereof, of (a pharmaceutically effective amount of) an amino acid sequence, compound, construct or polypeptide as described herein.

More in particular, the invention relates to the amino acid sequences, compounds, constructs, polypeptides, nucleic acids, host cells, products and compositions described herein for use in therapy of viral diseases.

Other aspects, embodiments, advantages and applications of the invention will also become clear from the further description herein, in which the invention will be described and discussed in more detail with reference to the NANOBODIES® ($V_{HH}$ sequences) of the invention and polypeptides of the invention comprising the same, which form some of the preferred aspects of the invention.

As will become clear from the further description herein, NANOBODIES® ($V_{HH}$ sequences) generally offer certain advantages (outlined herein) compared to "dAb's" or similar (single) domain antibodies or immunoglobulin sequences, which advantages are also provided by the NANOBODIES® ($V_{HH}$ sequences) of the invention. However, it will be clear to the skilled person that the more general aspects of the teaching below can also be applied (either directly or analogously) to other amino acid sequences of the invention.

DETAILED DESCRIPTION OF THE INVENTION

In the present description, examples and claims:

a) Unless indicated or defined otherwise, all terms used have their usual meaning in the art, which will be clear to the skilled person. Reference is for example made to the standard handbooks mentioned in paragraph a) on page 46 of WO 08/020079.

b) Unless indicated otherwise, the terms "immunoglobulin sequence", "sequence", "nucleotide sequence" and "nucleic acid" are as described in paragraph b) on page 46 of WO 08/020079, c) Unless indicated otherwise, all methods, steps, techniques and manipulations that are not specifically described in detail can be performed and have been performed in a manner known per se, as will be clear to the skilled person. Reference is for example again made to the standard handbooks and the general background art mentioned herein and to the further references cited therein; as well as to for example the following reviews Presta, Adv. Drug Deliv. Rev. 2006, 58 (5-6): 640-56; Levin and Weiss, Mol. Biosyst. 2006, 2(1): 49-57; Irving et al., J. Immunol. Methods, 2001, 248(1-2), 31-45; Schmitz et al., Placenta, 2000, 21 Suppl. A, S106-12, Gonzales et al., Tumour Biol., 2005, 26(1), 31-43, which describe techniques for protein engineering, such as affinity maturation and other techniques for improving the specificity and other desired properties of proteins such as immunoglobulins.

d) Amino acid residues will be indicated according to the standard three-letter or one-letter amino acid code. Reference is made to Table A-2 on page 48 of the International application WO 08/020079 of Ablynx N.V. entitled "Amino acid sequences directed against IL-6R and polypeptides comprising the same for the treatment of diseases and disorders associated with 11-6 mediated signalling".

e) For the purposes of comparing two or more nucleotide sequences, the percentage of "sequence identity" between a first nucleotide sequence and a second nucleotide sequence may be calculated or determined as described in paragraph c) on page 49 of WO 08/020079 (incorporated herein by reference), such as by dividing [the number of nucleotides in the first nucleotide sequence that are identical to the nucleotides at the corresponding positions in the second nucleotide sequence] by [the total number of nucleotides in the first nucleotide sequence] and multiplying by [100%], in which each deletion, insertion, substitution or addition of a nucleotide in the second nucleotide sequence—compared to the first nucleotide sequence—is considered as a difference at a single nucleotide (position); or using a suitable computer algorithm or technique, again as described in paragraph c) on pages 49 of WO 08/020079 (incorporated herein by reference).

f) For the purposes of comparing two or more amino acid sequences, the percentage of "sequence identity" between a first amino acid sequence and a second amino acid sequence (also referred to herein as "amino acid identity") may be calculated or determined as described in paragraph f) on pages 49 and 50 of WO 08/020079 (incorporated herein by reference), such as by dividing [the number of amino acid residues in the first amino acid sequence that are identical to the amino acid residues at the corresponding positions in the second amino acid sequence] by [the total number of amino acid residues in the first amino acid sequence] and multiplying by [100%], in which each deletion, insertion, substitution or addition of an amino acid residue in the second amino acid sequence—compared to the first amino acid sequence—is considered as a difference at a single amino acid residue (position), i.e. as an "amino acid difference" as defined herein; or using a suitable computer algorithm or technique, again as described in paragraph f) on pages 49 and 50 of WO 08/020079 (incorporated herein by reference).

Also, in determining the degree of sequence identity between two amino acid sequences, the skilled person may take into account so-called "conservative" amino acid substitutions, as described on page 50 of WO 08/020079.

Any amino acid substitutions applied to the polypeptides described herein may also be based on the analysis of the frequencies of amino acid variations between homologous proteins of different species developed by Schulz et al., Principles of Protein Structure, Springer-Verlag, 1978, on the analyses of structure forming potentials developed by Chou and Fasman, Biochemistry 13: 211, 1974 and Adv. Enzymol., 47: 45-149, 1978, and on the analysis of hydrophobicity patterns in proteins developed by Eisenberg et al., Proc. Natl. Acad Sci. USA 81: 140-144, 1984; Kyte & Doolittle; J Molec. Biol. 157: 105-132, 198 1, and Goldman et al., Ann. Rev. Biophys. Chem. 15: 321-353, 1986, all incorporated herein in their entirety by reference. Information on the primary, secondary and tertiary structure of NANOBODIES® ($V_{HH}$ sequences) is given in the description herein and in the general background art cited above. Also, for this purpose, the crystal structure of a $V_{HH}$ domain from a llama is for example given by Desmyter et al., Nature Structural Biology, Vol. 3, 9, 803 (1996); Spinelli et al., Natural Structural Biology (1996); 3, 752-757; and Decanniere et al., Structure, Vol. 7, 4, 361 (1999). Further information about some of the amino acid residues that in conventional $V_H$ domains form the $V_H/V_L$ interface and potential camelizing substitutions on these positions can be found in the prior art cited above.

g) Amino acid sequences and nucleic acid sequences are said to be "exactly the same" if they have 100% sequence identity (as defined herein) over their entire length;

h) When comparing two amino acid sequences, the term "amino acid difference" refers to an insertion, deletion or substitution of a single amino acid residue on a position of the first sequence, compared to the second sequence; it being understood that two amino acid sequences can contain one, two or more such amino acid differences;

i) When a nucleotide sequence or amino acid sequence is said to "comprise" another nucleotide sequence or amino acid sequence, respectively, or to "essentially consist of" another nucleotide sequence or amino acid sequence, this has the meaning given in paragraph i) on pages 51-52 of WO 08/020079.

j) The term "in essentially isolated form" has the meaning given to it in paragraph j) on pages 52 and 53 of WO 08/020079.

k) The terms "domain" and "binding domain" have the meanings given to it in paragraph k) on page 53 of WO 08/020079.

l) The terms "antigenic determinant" and "epitope", which may also be used interchangeably herein. have the meanings given to it in paragraph l) on page 53 of WO 08/020079.

m) As further described in paragraph m) on page 53 of WO 08/020079, an amino acid sequence (such as a NANOBODY® ($V_{HH}$ sequence), an antibody, a polypeptide of the invention, or generally an antigen binding protein or polypeptide or a fragment thereof) that can (specifically) bind to, that has affinity for and/or that has specificity for a specific antigenic determinant, epitope, antigen or protein (or for at least one part, fragment or epitope thereof) is said to be "against" or "directed against" said antigenic determinant, epitope, antigen or protein.

n) The term "specificity" has the meaning given to it in paragraph n) on pages 53-56 of WO 08/020079; and as mentioned therein refers to the number of different types of antigens or antigenic determinants to which a particular antigen-binding molecule or antigen-binding protein (such as a NANOBODY® ($V_{HH}$ sequence) or a polypeptide of the invention) molecule can bind. The specificity of an antigen-binding protein can be determined based on affinity and/or avidity, as described on pages 53-56 of WO 08/020079 (incorporated herein by reference), which also describes some preferred techniques for measuring binding between an antigen-binding molecule (such as a NANOBODY® ($V_{HH}$ sequence) or polypeptide of the invention) and the pertinent antigen. Typically, antigen-binding proteins (such as the amino acid sequences, NANOBODIES® ($V_{HH}$ sequences) and/or polypeptides of the invention) will bind to their antigen with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles). Any $K_D$ value greater than $10^4$ mol/liter (or any $K_A$ value lower than $10^4$ $M^{-1}$) liters/mol is generally considered to indicate non-specific binding. Preferably, a monovalent immunoglobulin sequence of the invention will bind to the desired antigen with an affinity less than 500 nM, preferably less than 200 nM, more preferably less than 10 nM, such as less than 500 pM. Specific binding of an antigen-binding protein to an antigen or antigenic determinant can be determined in any suitable manner known per se, including, for example, Scatchard analysis and/or competitive binding assays, such as radioimmunoassays (RIA), enzyme immunoassays (EIA) and sandwich competition assays, and the different variants thereof known per se in the art; as well as the other techniques mentioned herein. As will be clear to the skilled person, and as described on pages 53-56 of WO 08/020079, the dissociation constant may be the actual or apparent dissociation constant. Methods for determining the dissociation constant will be clear to the skilled person, and for example include the techniques mentioned on pages 53-56 of WO 08/020079.

o) The half-life of an amino acid sequence, compound or polypeptide of the invention can generally be defined as described in paragraph o) on page 57 of WO 08/020079 and as mentioned therein refers to the time taken for the serum concentration of the amino acid sequence, compound or polypeptide to be reduced by 50%, in vivo, for example due to degradation of the sequence or compound and/or clearance or sequestration of the sequence or compound by natural mechanisms. The in vivo half-life of an amino acid sequence, compound or polypeptide of the invention can be determined in any manner known per se, such as by pharmacokinetic analysis. Suitable techniques will be clear to the person skilled in the art, and may for example generally be as described in paragraph o) on page 57 of WO 08/020079. As also mentioned in paragraph o) on page 57 of WO 08/020079, the half-life can be expressed using parameters such as the t1/2-alpha, t1/2-beta and the area under the curve (AUC). Reference is for example made to the Experimental Part below, as well as to the standard handbooks, such as Kenneth, A et al: Chemical Stability of Pharmaceuticals: A Handbook for Pharmacists and Peters et al, Pharmacokinetic analysis: A Practical Approach (1996). Reference is also made to "Pharmacokinetics", M Gibaldi & D Perron, published by Marcel Dekker, 2nd Rev. edition (1982). The terms "increase in half-life" or "increased half-life" as also as defined in paragraph o) on page 57 of WO 08/020079 and in particular refer to an increase in the t1/2-beta, either with or without an increase in the t1/2-alpha and/or the AUC or both.

p) In the context of the present invention, "modulating" or "to modulate" generally means either reducing or inhibiting the activity of, or alternatively increasing the activity of, a target or antigen, as measured using a suitable in vitro, cellular or in vivo assay. In particular, "modulating" or "to modulate" may mean either reducing or inhibiting the activity of, or alternatively increasing a (relevant or intended) biological activity of, a target or antigen, as measured using a suitable in vitro, cellular or in vivo assay (which will usually depend on the target or antigen involved), by at least 1%, preferably at least 5%, such as at least 10% or at least 25%, for example by at least 50%, at least 60%, at least 70%, at least 80%, or 90% or more, compared to activity of the target or antigen in the same assay under the same conditions but without the presence of the construct of the invention.

As will be clear to the skilled person, "modulating" may also involve effecting a change (which may either be an increase or a decrease) in affinity, avidity, specificity and/or selectivity of a target or antigen for one or more of its binding partners, partners for association into a homomultimeric or heteromultimeric form; and/or effecting a change (which may either be an increase or a decrease) in the sensitivity of the target or antigen for one or more conditions in the medium or surroundings in which the target or antigen is present (such as pH, ion strength, the presence of co-factors, etc.), compared to the same conditions but without the presence of the construct of the invention. As will be clear to the skilled person, this may again be determined in any suitable manner and/or using any suitable assay known per se, depending on the target or antigen involved. "Modulating" may also mean effecting a change (i.e. an activity as an agonist, as an antagonist or as a reverse agonist, respectively, depending on the target or antigen and the desired biological or physiological effect) with respect to one or more biological or physiological mechanisms, effects, responses, functions, pathways or activities in which the target or antigen (or in which its binding partners or pathway(s) are involved, such as its signalling pathway or metabolic pathway and their associated biological or physiological effects) is involved. Again, as will be clear to the skilled person, such an action as an agonist or an antagonist may be determined in any suitable manner and/or using any suitable (in vitro and usually cellular or in assay) assay known per se, depending on the target or antigen involved. In particular, an action as an agonist or antagonist may be such that an intended biological or physiological activity is increased or decreased, respectively, by at least 1%, preferably at least 5%, such as at least 10% or at least 25%, for example by at least 50%, at least 60%, at least 70%, at least 80%, or 90% or more, compared to the biological or physiological activity in the same assay under the same conditions but without the presence of the construct of the invention. Modulating may for example also involve allosteric modulation of the target or antigen; and/or reducing or inhibiting the binding of the target or antigen to one of its binding partners and/or competing with a natural binding partner for binding to the target or antigen. Modulating may also involve activating the target or antigen or the mechanism or pathway in which it is involved. Modulating may for example also involve effecting a change in respect of the folding or conformation of the target or antigen, or in respect of the ability of the target or antigen to fold, to change its conformation (for example, upon binding of a binding partner), to associate with other (sub)units, or to disassociate. Modulating may for example also involve effecting a change in the ability of the target or antigen to transport other compounds or to serve as a channel for other compounds (such as ions).

Modulating may be reversible or irreversible, but for pharmaceutical and pharmacological purposes will usually be in a reversible manner.

q) In respect of a target or antigen, the term "interaction site" on the target or antigen means a site, epitope, antigenic determinant, part, domain or stretch of amino acid residues on the target or antigen that is a site for binding to a receptor or other binding partner, a catalytic site, a cleavage site, a site for allosteric interaction, a site involved in multimerisation (such as homomerization or heterodimerization) of the target or antigen; or any other site, epitope, antigenic determinant, part, domain or stretch of amino acid residues on the target or antigen that is involved in a biological action or mechanism of the target or antigen. More generally, an "interaction site" can be any site, epitope, antigenic determinant, part, domain or stretch of amino acid residues on the target or antigen to which an amino acid sequence or polypeptide of the invention can bind such that the target or antigen (and/or any pathway, interaction, signalling, biological mechanism or biological effect in which the target or antigen is involved) is modulated (as defined herein).

r) An amino acid sequence or polypeptide is said to be "specific for" a first target or antigen compared to a second target or antigen when is binds to the first antigen with an affinity (as described above, and suitably expressed as a $K_D$ value, $K_A$ value, $K_{off}$ rate and/or $K_{on}$ rate) that is at least 10 times, such as at least 100 times, and preferably at least 1000 times, and up to 10.000 times or more better than the affinity with which said amino acid sequence or polypeptide binds to the second target or polypeptide. For example, the first antigen may bind to the target or antigen with a $K_D$ value that is at least 10 times less, such as at least 100 times less, and preferably at least 1000 times less, such as 10.000 times less or even less than that, than the $K_D$ with which said amino acid sequence or polypeptide binds to the second target or polypeptide. Preferably, when an amino acid sequence or polypeptide is "specific for" a first target or antigen compared to a second target or antigen, it is directed against (as defined herein) said first target or antigen, but not directed against said second target or antigen.

s) The terms "cross-block", "cross-blocked" and "cross-blocking" are used interchangeably herein to mean the ability of an amino acid sequence or other binding agent (such as a polypeptide of the invention) to interfere with the binding of other amino acid sequences or binding agents of the invention to a given target. The extend to which an amino acid sequence or other binding agents of the invention is able to interfere with the binding of another to the target, and therefore whether it can be said to cross-block according to the invention, can be determined using competition binding assays. One particularly suitable quantitative cross-blocking assay uses a Biacore machine which can measure the extent of interactions using surface plasmon resonance technology. Another suitable quantitative cross-blocking assay uses an ELISA-based approach to measure competition between amino acid sequences or other binding agents in terms of their binding to the target.

The following generally describes a suitable Biacore assay for determining whether an amino acid sequence or other binding agent cross-blocks or is capable of cross-blocking according to the invention. It will be appreciated that the assay can be used with any of the amino acid sequences or other binding agents described herein. The Biacore machine (for example the Biacore 3000) is operated in line with the manufacturer's recommendations. Thus in one cross-blocking assay, the target protein is coupled to a CM5 Biacore chip using standard amine coupling chemistry to generate a surface that is coated with the target. Typically 200-800 resonance units of the target would be coupled to the chip (an amount that gives easily measurable levels of binding but that is readily saturable by the concentrations of test reagent being used). Two test amino acid sequences (termed A* and B*) to be assessed for their ability to cross-block each other are mixed at a one to one molar ratio of binding sites in a suitable buffer to create the test mixture. When calculating the concentrations on a binding site basis the molecular weight of an amino acid sequence is assumed to be the total molecular weight of the amino acid sequence divided by the number of target binding sites on that amino acid sequence. The concentration of each amino acid sequence in the test mix should be high enough to readily saturate the binding sites for that amino acid sequence on the target molecules captured on the Biacore chip. The amino acid sequences in the mixture are at the same molar concentration (on a binding basis) and that concentration would typically be between 1.00 and 1.5 micromolar (on a binding site basis). Separate solutions containing A* alone and B* alone are also prepared. A* and B* in these solutions should be in the same buffer and at the same concentration as in the test mix. The test mixture is passed over the target-coated Biacore chip and the total amount of binding recorded. The chip is then treated in such a way as to remove the bound amino acid sequences without damaging the chip-bound target. Typically this is done by treating the chip with 30 mM HCl for 60 seconds. The solution of A* alone is then passed over the target-coated surface and the amount of binding recorded. The chip is again treated to remove all of the bound amino acid sequences without damaging the chip-bound target. The solution of B* alone is then passed over the target-coated surface and the amount of binding recorded. The maximum theoretical binding of the mixture of A* and B* is next calculated, and is the sum of the binding of each amino acid sequence when passed over the target surface alone. If the actual recorded binding of the mixture is less than this theoretical maximum then the two amino acid sequences are cross-blocking each other. Thus, in general, a cross-blocking amino acid sequence or other binding agent according to the invention is one which will bind to the target in the above Biacore cross-blocking assay such that during the assay and in the presence of a second amino acid sequence or other binding agent of the invention the recorded binding is between 80% and 0.1% (e.g. 80% to 4%) of the maximum theoretical binding, specifically between 75% and 0.1% (e.g. 75% to 4%) of the maximum theoretical binding, and more specifically between 70% and 0.1% (e.g. 70% to 4%) of maximum theoretical binding (as just defined above) of the two amino acid sequences or binding agents in combination. The Biacore assay described above is a primary assay used to determine if amino acid sequences or other binding agents cross-block each other according to the invention. On rare occasions particular amino acid sequences or other binding agents may not bind to a target coupled via amine chemistry to a CM5 Biacore chip (this usually occurs when the relevant binding site on the target is masked or destroyed by the coupling to the chip). In such cases cross-blocking can be determined using a tagged version of the target, for example a N-terminal His-tagged version. In this particular format, an anti-His amino acid sequence would be coupled to the Biacore chip and then the His-tagged target would be passed over the surface of the chip and captured by the anti-His amino acid sequence. The cross blocking analysis would be carried out essentially as described above, except that after each chip regeneration cycle, new His-tagged target would be loaded back onto the anti-His amino acid sequence coated surface. In addition to the example given using N-terminal His-tagged target, C-terminal His-tagged target could alternatively be used. Furthermore, various other tags and tag binding protein combinations that are known in the art could be used for such a cross-blocking analysis (e.g. HA tag with anti-HA antibodies; FLAG tag with anti-FLAG antibodies; biotin tag with streptavidin).

The following generally describes an ELISA assay for determining whether an amino acid sequence or other binding agent directed against a target cross-blocks or is capable of cross-blocking as defined herein. It will be appreciated that the assay can be used with any of the amino acid sequences (or other binding agents such as polypeptides of the invention) described herein. The general principal of the assay is to have an amino acid sequence or binding agent that is directed against the target coated onto the wells of an ELISA plate. An excess amount of a second, potentially cross-blocking, anti-target amino acid sequence is added in solution (i.e. not bound to the ELISA plate). A limited amount of the target is then added to the wells. The coated amino acid sequence and the amino acid sequence in solution compete for binding of the limited number of target molecules. The plate is washed to remove excess target that has not been bound by the coated amino acid sequence and to also remove the second, solution phase amino acid sequence as well as any complexes formed between the second, solution phase amino acid sequence and target. The amount of bound target is then measured using a reagent that is appropriate to detect the target. An amino acid sequence in solution that is able to cross-block the coated amino acid sequence will be able to cause a decrease in the number of target molecules that the coated amino acid sequence can bind relative to the number of target molecules that the coated amino acid sequence can bind in the absence of the second, solution phase, amino acid sequence. In the instance where the first amino acid sequence, e.g. an Ab-X, is chosen to be the immobilized amino acid sequence, it is coated onto the wells of the ELISA plate, after which the plates are blocked with a suitable blocking solution to minimize non-specific binding of reagents that are subsequently added. An excess amount of the second amino acid sequence, i.e. Ab-Y, is then added to the ELISA plate such that the moles of Ab-Y target binding sites per well are at least 10 fold higher than the moles of Ab-X target binding sites that were used, per well, during the coating of the ELISA plate. Target is then added such that the moles of target added per well are at least 25-fold lower than the moles of Ab-X target binding sites that were used for coating each well. Following a suitable incubation period the ELISA plate is washed and a reagent for detecting the target is added to measure the amount of target specifically bound by the coated anti-target amino acid sequence (in this case Ab-X). The background signal for the assay is defined as the signal obtained in wells with the coated amino acid sequence (in this case Ab-X), second solution phase amino acid sequence (in this case Ab-Y), target buffer only (i.e. without target) and target detection reagents. The positive control signal for the assay is defined as the signal obtained in wells with the coated amino acid sequence (in this case Ab-X), second solution phase amino acid sequence buffer only (i.e. without second solution phase amino acid sequence), target and target detection reagents. The ELISA assay may be run in such a manner so as to have the positive control signal be at least 6 times the background signal. To avoid any artefacts (e.g. significantly different affinities between Ab-X and Ab-Y for the target) resulting from the choice of which amino acid sequence to use as the coating amino acid sequence and which to use as the second (competitor) amino acid sequence, the cross-blocking assay may to be run in two formats: 1) format 1 is where Ab-X is the amino acid sequence that is coated onto the ELISA plate and Ab-Y is the competitor amino acid sequence that is in solution and 2) format 2 is where Ab-Y is the amino acid sequence that is coated onto the ELISA plate and Ab-X is the competitor amino acid sequence that is in solution. Ab-X and Ab-Y are defined as cross-blocking if, either in format 1 or in format 2, the solution phase anti-target amino acid sequence is able to cause a reduction of between 60% and 100%, specifically between 70% and 100%, and more specifically between 80% and 100%, of the target detection signal {i.e. the amount of target bound by the coated amino acid sequence) as compared to the target detection signal obtained in the absence of the solution phase anti-target amino acid sequence (i.e. the positive control wells).

t) An amino acid sequence is said to be "cross-reactive" for two different antigens or antigenic determinants (such as e.g. serum albumin from two different species of mammal, such as e.g. human serum albumin and cyno serum albumin, such as e.g. the same envelop proteins of different strains of a virus, such as e.g. the same envelope proteins of different genotypes of a virus) if it is specific for (as defined herein) both these different antigens or antigenic determinants.

u) By binding that is "essentially independent of the pH" is generally meant herein that the association constant ($K_A$) of the amino acid sequence with respect to the serum protein (such as serum albumin) at the pH value(s) that occur in a cell of an animal or human body (as further described herein) is at least 5%, such as at least 10%, preferably at least 25%, more preferably at least 50%, even more preferably at least 60%, such as even more preferably at least 70%, such as at least 80% or 90% or more (or even more than 100%, such as more than 110%, more than 120% or even 130% or more, or even more than 150%, or even more than 200%) of the association constant ($K_A$) of the amino acid sequence with respect to the same serum protein at the pH value(s) that occur outside said cell. Alternatively, by binding that is "essentially independent of the pH" is generally meant herein that the $k_{off}$ rate (measured by Biacore) of the amino acid sequence with respect to the serum protein (such as serum albumin) at the pH value(s) that occur in a cell of an animal or human body (as e.g. further described herein, e.g. pH around 5.5, e.g. 5.3 to 5.7) is at least 5%, such as at least 10%, preferably at least 25%, more preferably at least 50%, even more preferably at least 60%, such as even more preferably at least 70%, such as at least 80% or 90% or more (or even more than 100%, such as more than 110%, more than 120% or even 130% or more, or even more than 150%, or even more than 200%) of the $k_{off}$ rate of the amino acid sequence with respect to the same serum protein at the pH value(s) that occur outside said cell, e.g. pH 7.2 to 7.4. By "the pH value(s) that occur in a cell of an animal or human body" is meant the pH value(s) that may occur inside a cell, and in particular inside a cell that is involved in the recycling of the serum protein. In particular, by "the pH value(s) that occur in a cell of an animal or human body" is meant the pH value(s) that may occur inside a (sub)cellular compartment or vesicle that is involved in recycling of the serum protein (e.g. as a result of pinocytosis, endocytosis, transcytosis, exocytosis and phagocytosis or a similar mechanism of uptake or internalization into said cell), such as an endosome, lysosome or pinosome.

v) As further described herein, the total number of amino acid residues in a NANOBODY® ($V_{HH}$ sequence) can be in the region of 110-120, is preferably 112-115, and is most preferably 113. It should however be noted that parts, fragments, analogs or derivatives (as further described herein) of a NANOBODY® ($V_{HH}$ sequence) are not particularly limited as to their length and/or size, as long as such parts, fragments, analogs or derivatives meet the further requirements outlined herein and are also preferably suitable for the purposes described herein;

w) As further described in paragraph q) on pages 58 and 59 of WO 08/020079 (incorporated herein by reference), the amino acid residues of a NANOBODY® ($V_{HH}$ sequence) are numbered according to the general numbering for $V_H$ domains given by Kabat et al. ("Sequence of proteins of immunological interest", US Public Health Services, NIH Bethesda, Md., Publication No. 91), as applied to $V_{HH}$ domains from Camelids in the article of Riechmann and Muyldermans, J. Immunol. Methods 2000 Jun. 23; 240 (1-2): 185-195 (see for example FIG. 2 of this publication), and accordingly FR1 of a NANOBODY® ($V_{HH}$ sequence) comprises the amino acid residues at positions 1-30, CDR1 of a NANOBODY® ($V_{HH}$ sequence) comprises the amino acid residues at positions 31-35, FR2 of a NANOBODY® ($V_{HH}$ sequence) comprises the amino acids at positions 36-49, CDR2 of a NANOBODY® ($V_{HH}$ sequence) comprises the amino acid residues at positions 50-65, FR3 of a NANOBODY® ($V_{HH}$ sequence) comprises the amino acid residues at positions 66-94, CDR3 of a NANOBODY® ($V_{HH}$ sequence) comprises the amino acid residues at positions 95-102, and FR4 of a NANOBODY® ($V_{HH}$ sequence) comprises the amino acid residues at positions 103-113.

x) In the context of the present invention "target host cell (of a virus)" generally refers to a particular cell, which is or is derived from a living subject, being susceptible to infection with said virus.

y) The term "infectivity of a virus", as used herein, refers to the proportion of living subjects that, when exposed to said virus, actually become infected by said virus.

z) The term "neutralization of a virus", as used herein, refers to the modulation and/or reduction and/or prevention and/or inhibition of the infectivity (as defined herein) of a virus by binding of a neutralizing compound to the virion, as measured using a suitable in vitro, cellular or in vivo assay (such as those mentioned herein). In particular, "neutralizing (a virus)" or "to neutralize (a virus)" may mean either modulating, reducing, preventing or inhibiting the infectivity (as defined herein) of a virus, which can be mediated by an envelope protein of a virus and/or its viral receptor as measured using a suitable in vitro, cellular or in vivo assay (such as those mentioned herein), by at least 1%, preferably at least 5%, such as at least 10% or at least 25%, for example by at least 50%, at least 60%, at least 70%, at least 80%, or 90% or more, compared to normal (i.e. naturally occurring) infectivity (as defined herein) of a virus, which is mediated by an envelope protein of a virus and/or its viral receptor in the same assay under the same conditions but without the presence of the amino acid sequence, NANOBODY® ($V_{HH}$ sequence) or polypeptide of the invention.

aa) The term "viral attachment protein", as used herein, is any protein that is present on the virion surface and that is able to directly (for example by interacting with a viral receptor) or indirectly (for example by mediating the interaction of one or more other proteins or molecules to a viral receptor) mediate viral attachment to a target host cell.

bb) The term "viral fusion protein", as used herein, is any protein that is present on the virion surface and that is able to directly (for example by interacting with membrane compounds of the target host cell) or indirectly (for example by mediating the interaction of one or more other proteins or molecules with membrane compounds of the target host cell) mediate viral fusion to a target host cell.

cc) The term "viral attachment and viral fusion protein", as used herein is any protein that is present on the virion surface and that is able to directly (for example by interacting with a viral receptor and/or membrane compounds of the target host cell) or indirectly (for example by mediating the interaction of one or more other proteins or molecules to a viral receptor and/or one or more other proteins or molecules with membrane compounds of the target host cell) mediate viral attachment and viral fusion to a target host cell.

dd) The term "pre-fusion conformational state (of a viral (attachment, fusion, or both attachment and fusion) protein)", as used herein, refers to the primary and/or secondary and/or tertiary and/or quaternary conformational state of a viral (attachment, fusion, or both attachment and fusion) protein before and/or during the fusion process of a virion with its target host cell, wherein said virion has said viral (attachment, fusion, or both attachment and fusion) protein exposed on its surface.

ee) The term "intermediate fusion conformational state (of a viral (attachment, fusion, or both attachment and fusion) protein)", as used herein, refers to the primary and/or secondary and/or tertiary and/or quaternary conformational state of a viral (attachment, fusion, or both attachment and fusion) protein during the fusion process of a virion with its target host cell, wherein said virion has said viral (attachment, fusion, or both attachment and fusion) protein exposed on its surface.

ff) The term "post-fusion conformational state (of a viral (attachment, fusion, or both attachment and fusion) protein)", as used herein, refers to the primary and/or secondary and/or tertiary and/or quaternary conformational state of a viral (attachment, fusion, or both attachment and fusion) protein during and/or after the fusion process of a virion with its target host cell, wherein said virion has said viral (attachment, fusion, or both attachment and fusion) protein exposed on its surface.

gg) The term "viral receptor", as used herein, refers to a specific molecular component of the cell, which is capable of recognizing and interacting with a virus, and which, after binding to said virus, is capable of generating a signal that initiates a chain of events leading to a biological response.

hh) The term "viral entry" used herein encompasses any viral-mediated biological pathway that is needed to accomplish virion attachment to a target host cell and/or viral fusion with a target host cell. It is encompassed in the present invention that viral entry, which may be any viral-mediated biological pathway that is needed to accomplish virion attachment to a target host cell and/or viral fusion with a target host cell, can be modulated and/or reduced and/or prevented and/or inhibited by specific binding of the amino acid sequences, NANOBODIES® ($V_{HH}$ sequences), polypeptides and/or compounds of the invention to an envelope protein of a virus, as measured using a suitable in vitro, cellular or in vivo assay (such as those mentioned herein). In particular, viral entry, which can be mediated by an envelope protein of a virus and/or its viral receptor, can be modulated, reduced, prevented or inhibited by specific binding of the amino acid sequences, NANOBODIES® ($V_{HH}$ sequences), polypeptides and/or compounds of the invention to an envelope protein of a virus, as measured using a suitable in vitro, cellular or in vivo assay (such as those mentioned herein), by at least 1%, preferably at least 5%, such as at least 10% or at least 25%, for example by at least 50%, at least 60%, at least 70%, at least 80%, or 90% or more, compared to normal (i.e. naturally occurring) viral entry (as defined herein), which can be mediated by an envelope protein of a virus and/or its viral receptor in the same assay under the same conditions but without the presence of the amino acid sequence, NANOBODY® ($V_{HH}$ sequence), polypeptide and/or compound of the invention. Thus, it is also encompassed that that viral attachment and/or viral fusion can be modulated and/or reduced and/or prevented and/or inhibited by specific binding of the amino acid sequences, NANOBODIES® ($V_{HH}$ sequences), polypeptides and/or compounds of the invention to an envelope protein of a virus, as measured using a suitable in vitro, cellular or in vivo assay (such as those mentioned herein). In particular, viral attachment and/or viral fusion, which can be mediated by an envelope protein of a virus and/or its viral receptor, can be modulated, reduced, prevented or inhibited by specific binding of the amino acid sequences, NANOBODIES® ($V_{HH}$ sequences), polypeptides and/or compounds of the invention to an envelope protein of a virus, as measured using a suitable in vitro, cellular or in vivo assay (such as those mentioned herein), by at least 1%, preferably at least 5%, such as at least 10% or at least 25%, for example by at least 50%, at least 60%, at least 70%, at least 80%, or 90% or more, compared to normal (i.e. naturally occurring) viral attachment and/or viral fusion, which can be mediated by an envelope protein of a virus and/or its viral receptor in the same assay under the same conditions but without the presence of the amino acid sequence, NANOBODY® ($V_{HH}$ sequence), polypeptide and/or compound of the invention.

ii) The term "viral replication" used herein encompasses any viral-mediated biological pathway that is needed to accomplish transcription and/or translation of the viral genome and/or viral packaging and/or the formation of functional virions and/or budding of nascent virions from the target host cell membrane. It is encompassed in the present invention that viral replication, which may be any viral-mediated biological pathway that is needed to accomplish transcription and/or translation of the viral genome and/or viral packaging and/or the formation of functional virions and/or budding of nascent virions from the target host cell membrane, can be modulated and/or reduced and/or prevented and/or inhibited by specific binding of the amino acid sequences, NANOBODIES® ($V_{HH}$ sequences), polypeptides and/or compounds of the invention to an envelope protein of a virus, as measured using a suitable in vitro, cellular or in vivo assay (such as those mentioned herein). In particular, viral replication, which can be mediated by an envelope protein of a virus and/or its viral receptor, can be modulated, reduced, prevented or inhibited by specific binding of the amino acid sequences, NANOBODIES® ($V_{HH}$ sequences), polypeptides and/or compounds of the invention to an envelope protein of a virus, as measured using a suitable in vitro, cellular or in vivo assay (such as those mentioned herein), by at least 1%, preferably at least 5%, such as at least 10% or at least 25%, for example by at least 50%, at least 60%, at least 70%, at least 80%, or 90% or more, compared to normal (i.e. naturally occurring) viral replication (as defined herein), which can be mediated by an envelope protein of a virus and/or its viral receptor, in the same assay under the same conditions but without the presence of the amino acid sequence, NANOBODY® ($V_{HH}$ sequence), polypeptide and/or compound of the invention. Thus, it is also encompassed that transcription and/or translation of the viral genome and/or viral packaging and/or the formation of functional virions and/or budding of nascent virions from the target host cell membrane can be modulated and/or reduced and/or prevented and/or inhibited by specific binding of the amino acid sequences, NANOBODIES® ($V_{HH}$ sequences), polypeptides and/or compounds of the invention to an envelope protein of a virus, as measured using a suitable in vitro, cellular or in vivo assay (such as those mentioned herein). In particular, transcription and/or translation of the viral genome and/or viral packaging and/or the formation of functional virions and/or budding of nascent virions from the target host cell membrane, which can be mediated by an envelope protein of a virus and/or its viral receptor, can be modulated, reduced, prevented or inhibited by specific binding of the amino acid sequences, NANOBODIES® ($V_{HH}$ sequences), polypeptides and/or compounds of the invention to an envelope protein of a virus, as measured using a suitable in vitro, cellular or in vivo assay (such as those mentioned herein), by at least 1%, preferably at least 5%, such as at least 10% or at least 25%, for example by at least 50%, at least 60%, at least 70%, at least 80%, or 90% or more, compared to normal (i.e. naturally occurring) transcription and/or translation of the viral genome and/or viral packaging and/or the formation of functional virions and/or budding of nascent virions from the target host cell membrane, which can be mediated by an envelope protein of a virus and/or its viral receptor in the same assay under the same conditions but without the presence of the amino acid sequence, NANOBODY® ($V_{HH}$ sequence), polypeptide and/or compound of the invention.

jj) In the context of the present invention "a virus" may be any virus that is generally known in the art. In particular, said virus may be chosen from the group consisting of a DNA virus (such as but not limited to a dsDNA virus or a ssDNA virus), an RNA virus (such as but not limited to a dsRNA virus, a positive-sense ssRNA virus or a negative-sense ssRNA virus) and a Reverse Transcriptase (RT) virus (such as but not limited to dsDNA-RT virus and a ssRNA-RT virus. For example, said virus may belong to a viral family chosen from the group consisting of Orthomyxoviridae, Paramyxoviridae, Filoviridae, Retroviridae, Coronaviridae, Togaviridae and Flaviviridae, Rhabdoviridae, Herpesviridae, Arenaviridae, Bornaviridae, Bunyaviridae, Hepadnaviridae and Poxviridae; and said virus may for instance belong to a viral genus chosen from the group consisting of Alphaviruses and Flaviviruses. Accordingly, amino acid sequences, polypeptides and compositions according to the invention may be directed against at least one epitope of an envelope protein of any of the foregoing viruses, chosen from the group consisting of a DNA virus (such as but not limited to a ds DNA virus or a ssDNA virus), an RNA virus (such as but not limited to a dsRNA virus, a positive-sense ssRNA virus or a negative-sense ssRNA virus) and a Reverse Transcriptase (RT) virus (such as but not limited to dsDNA-RT virus and a ssRNA-RT virus. For example, said virus may belong to a viral family chosen from the group consisting of Orthomyxoviridae, Paramyxoviridae, Filoviridae, Retroviridae, Coronaviridae, Togaviridae and Flaviviridae, Rhabdoviridae, Herpesviridae, Arenaviridae, Bornaviridae, Bunyaviridae, Hepadnaviridae and Poxviridae; and in particular said virus may for instance belong to a viral genus chosen from the group consisting of Alphaviruses and Flaviviruses.

kk) The Figures, Sequence Listing and the Experimental Part/Examples are only given to further illustrate the invention and should not be interpreted or construed as limiting the scope of the invention and/or of the appended claims in any way, unless explicitly indicated otherwise herein.

For a general description of heavy chain antibodies and the variable domains thereof, reference is inter alia made to the prior art cited herein, as well as to the prior art mentioned on page 59 of WO 08/020079 and to the list of references mentioned on pages 41-43 of the International application WO 06/040153, which prior art and references are incorporated herein by reference.

In accordance with the terminology used in the art (see the above references), the variable domains present in naturally occurring heavy chain antibodies will also be referred to as "$V_{HH}$ domains", in order to distinguish them from the heavy chain variable domains that are present in conventional 4-chain antibodies (which will be referred to hereinbelow as "$V_H$ domains") and from the light chain variable domains that are present in conventional 4-chain antibodies (which will be referred to hereinbelow as "$V_L$ domains").

As mentioned in the prior art referred to above, $V_{HH}$ domains have a number of unique structural characteristics and functional properties which make isolated $V_{HH}$ domains (as well as NANOBODIES® ($V_{HH}$ sequences) based thereon, which share these structural characteristics and functional properties with the naturally occurring $V_{HH}$ domains) and proteins containing the same highly advantageous for use as functional antigen-binding domains or proteins. In particular, and without being limited thereto, $V_{HH}$ domains (which have been "designed" by nature to functionally bind to an antigen without the presence of, and without any interaction with, a light chain variable domain) and NANOBODIES® ($V_{HH}$ sequences) can function as a single, relatively small, functional antigen-binding structural unit, domain or protein. This distinguishes the $V_{HH}$ domains from the $V_H$ and $V_L$ domains of conventional 4-chain antibodies, which by themselves are generally not suited for practical application as single antigen-binding proteins or domains, but need to be combined in some form or another to provide a functional antigen-binding unit (as in for example conventional antibody fragments such as Fab fragments; in ScFv's fragments, which consist of a $V_H$ domain covalently linked to a $V_L$ domain).

Because of these unique properties, the use of $V_{HH}$ domains and NANOBODIES® ($V_{HH}$ sequences) as single antigen-binding proteins or as antigen-binding domains (i.e. as part of a larger protein or polypeptide) offers a number of significant advantages over the use of conventional $V_H$ and $V_L$ domains, scFv's or conventional antibody fragments (such as Fab- or $F(ab')_2$-fragments), including the advantages that are listed on pages 60 and 61 of WO 08/020079.

In a specific and preferred aspect, the invention provides NANOBODIES® ($V_{HH}$ sequences) against an envelope protein of a virus, and in particular NANOBODIES® ($V_{HH}$ sequences) against an envelope protein of a virus that is able to infect a warm-blooded animal, and more in particular NANOBODIES® ($V_{HH}$ sequences) against an envelope protein of a virus that is able to infect a mammal, and especially NANOBODIES® ($V_{HH}$ sequences) against an envelope protein of a human virus; as well as proteins and/or polypeptides comprising at least one such NANOBODY® ($V_{HH}$ sequence).

In particular, the invention provides NANOBODIES® ($V_{HH}$ sequences) against an envelope protein of a virus, and proteins and/or polypeptides comprising the same, that have improved therapeutic and/or pharmacological properties and/or other advantageous properties (such as, for example, improved ease of preparation and/or reduced costs of goods), compared to conventional antibodies against an envelope protein of a virus or fragments thereof, compared to constructs that could be based on such conventional antibodies or antibody fragments (such as Fab' fragments, $F(ab')_2$ fragments, ScFv constructs, "diabodies" and other multispecific constructs (see for example the review by Holliger and Hudson, Nat. Biotechnol. 2005 September; 23(9):1126-36)), and also compared to the so-called "dAb's" or similar (single) domain antibodies that may be derived from variable domains of conventional antibodies. These improved and advantageous properties will become clear from the further description herein, and for example include, without limitation, one or more of:

- increased affinity and/or avidity for an envelope protein of a virus, either in a monovalent format, in a multivalent format (for example in a bivalent or trivalent format) and/or in a multispecific format (for example one of the multispecific formats described herein);
- better suitability for formatting in a multivalent format (for example in a bivalent or trivalent format);
- better suitability for formatting in a multispecific format (for example one of the multispecific formats described herein);
- improved suitability or susceptibility for "humanizing" substitutions (as defined herein);
- less immunogenicity, either in a monovalent format, in a multivalent format (for example in a bivalent or trivalent format) and/or in a multispecific format (for example one of the multispecific formats described herein);
- increased stability, either in a monovalent format, in a multivalent format (for example in a bivalent or trivalent format) and/or in a multispecific format (for example one of the multispecific formats described herein);
- increased specificity towards an envelope protein of a virus, either in a monovalent format, in a multivalent format (for example in a bivalent or trivalent format) and/or in a multispecific format (for example one of the multispecific formats described herein);
- decreased or where desired increased cross-reactivity with an envelope protein of a virus from different species;

and/or

- one or more other improved properties desirable for pharmaceutical use (including prophylactic use and/or therapeutic use) and/or for diagnostic use (including but not limited to use for imaging purposes), either in a monovalent format, in a multivalent format (for example in a bivalent or trivalent format) and/or in a multispecific format (for example one of the multispecific formats described hereinbelow).

As generally described herein for the amino acid sequences of the invention, the NANOBODIES® ($V_{HH}$ sequences) of the invention are preferably in essentially isolated form (as defined herein), or form part of a protein or polypeptide of the invention (as defined herein), which may comprise or essentially consist of one or more NANOBODIES® ($V_{HH}$ sequences) of the invention and which may optionally further comprise one or more further amino acid sequences (all optionally linked via one or more suitable linkers). For example, and without limitation, the one or more amino acid sequences of the invention may be used as a binding unit in such a protein or polypeptide, which may optionally contain one or more further amino acid sequences that can serve as a binding unit (i.e. against one or more other targets than an envelope protein of a virus), so as to provide a monovalent, multivalent or multispecific polypeptide of the invention, respectively, all as described herein. In particular, such a protein or polypeptide may comprise or essentially consist of one or more NANOBODIES® ($V_{HH}$ sequences) of the invention and optionally one or more (other) NANOBODIES® ($V_{HH}$ sequences) (i.e. directed against other targets than an envelope protein of a virus), all optionally linked via one or more suitable linkers, so as to provide a monovalent, multivalent or multispecific NANOBODY® ($V_{HH}$ sequence) construct, respectively, as further described herein. Such proteins or polypeptides may also be in essentially isolated form (as defined herein).

In a NANOBODY® ($V_{HH}$ sequence) of the invention, the binding site for binding against an envelope protein of a virus is preferably formed by the CDR sequences. Optionally, a NANOBODY® ($V_{HH}$ sequence) of the invention may also, and in addition to the at least one binding site for binding to an envelope protein of a virus, contain one or more further binding sites for binding against other antigens, proteins or targets. For methods and positions for introducing such second binding sites, reference is for example made to Keck and Huston, Biophysical Journal, 71, October 1996, 2002-2011; EP 0 640 130; and WO 06/07260.

As generally described herein for the amino acid sequences of the invention, when a NANOBODY® ($V_{HH}$ sequence) of the invention (or a polypeptide of the invention comprising the same) is intended for administration to a subject (for example for prophylactic, therapeutic and/or diagnostic purposes as described herein), it is preferably directed against an envelope protein of a virus that is able to infect humans;

whereas for veterinary purposes, it is preferably directed against an envelope protein of a virus that is able to infect the species to be treated. Also, as with the amino acid sequences of the invention, a NANOBODY® ($V_{HH}$ sequence) of the invention may or may not be cross-reactive (i.e. directed against two or more homologous envelope proteins of a virus that is able to infect two or more species of mammal, such as against two or more homologous envelope proteins of a virus that is both able to infect humans and at least one of the species of mammal mentioned herein).

A NANOBODY® ($V_{HH}$ sequence) of the invention may or may not be cross-reactive for two or more different genotypes, subtypes, viral escape mutants and/or strains of a certain virus. In this respect, the present invention provides multivalent NANOBODIES® ($V_{HH}$ sequences) or polypeptides which show increased cross-reactivity for different genotypes, subtypes, viral escape mutants and/or strains of a certain virus compared to the corresponding monovalent NANOBODY® ($V_{HH}$ sequence). In one aspect, the (multivalent) NANOBODIES® ($V_{HH}$ sequences) are directed against influenza virus and may bind influenza subtype H5N1 as well as influenza subtype H1N1. In another aspect, the (multivalent) NANOBODIES® ($V_{HH}$ sequences) are directed against influenza virus and may bind influenza subtype H5N1 as well as influenza subtype H3N2. In another aspect, the (multivalent) NANOBODIES® ($V_{HH}$ sequences) are directed against influenza virus and may bind influenza subtype H1N1 as well as influenza subtype H3N2. In another aspect, the (multivalent) NANOBODIES® ($V_{HH}$ sequences) are directed against influenza virus and may bind influenza subtype H5N1 as well as influenza subtype H2N2. Yet in another aspect, the (multivalent) NANOBODIES® ($V_{HH}$ sequences) are directed against influenza virus and may bind influenza subtype H5N1, influenza subtype H1N1 as well as influenza subtype H3N2. Yet in another aspect, the (multivalent) NANOBODIES® ($V_{HH}$ sequences) are directed against influenza virus and may bind influenza subtype H5N1, influenza subtype H2N2 as well as influenza subtype H3N2. Yet in another aspect, the (multivalent) NANOBODIES® ($V_{HH}$ sequences) are directed against influenza virus and may bind influenza subtype H5N1, influenza subtype H1N1 as well as influenza subtype H2N2. Yet in another aspect, the (multivalent) NANOBODIES® ($V_{HH}$ sequences) are directed against influenza virus and may bind influenza subtype H5N1, influenza subtype H1N1, influenza subtype H2N2 as well as influenza subtype H3N2. In another aspect, the (multivalent) NANOBODIES® ($V_{HH}$ sequences) are directed against rabies virus and may bind rabies genotype 1 as well as genotype 5. In yet another aspect, the (multivalent) NANOBODIES® ($V_{HH}$ sequences) are directed against RSV and may bind different strains of RSV (such as e.g. Long, A-2 and/or B-1). In yet another aspect, the (multivalent) NANOBODIES® ($V_{HH}$ sequences) are directed against RSV and may bind different escape mutants of RSV (such as e.g. described in Lopez et al. 1998, J. Virol. 72: 6922-6928) and/or escape mutants specific for antigen site II, antigen site IV-VI or the combination of both antigenic sites.

Also, again as generally described herein for the amino acid sequences of the invention, the NANOBODIES® ($V_{HH}$ sequences) of the invention may generally be directed against any antigenic determinant, epitope, part, domain, subunit or conformation (where applicable) of an envelope protein of a virus.

However, it is generally assumed and preferred that the NANOBODIES® ($V_{HH}$ sequences) and polypeptides of the invention are preferably directed against an interaction site (as defined herein), and in particular against at least one epitope of an envelope protein of a virus, such that at least one viral-mediated biological pathway in which an envelope protein of a virus and/or a viral receptor are involved is inhibited, prevented and/or modulated.

In particular, it is assumed and preferred that the NANOBODIES® ($V_{HH}$ sequences), polypeptides and compositions of the present invention are directed against at least one epitope of an envelope protein of a virus, such that viral entry in a target host cell (such as for instance virion attachment to a target host cell and/or viral fusion with a target host cell) and/or viral replication in a target host cell (such as for instance viral transcription and/or viral translation and/or viral packaging and/or the formation of functional virions and/or budding of nascent virions from the target host cell membrane) is inhibited, prevented and/or modulated.

The NANOBODIES® ($V_{HH}$ sequences) and polypeptides may be directed against at least one epitope of an envelope protein of a virus that is surface-exposed or that is located in a cavity or cleft formed by an envelope protein of a virus. Preferably, the NANOBODIES® ($V_{HH}$ sequences) and polypeptides of the invention are directed against an interaction site (as defined herein), and in particular against an epitope that is located in a cavity or cleft formed by a trimer of fusion proteins (such as a fusion protein trimer that is a trimer of hairpins or a six-helix bundle) or a dimer of fusion proteins, wherein said fusion proteins can be in their pre-, intermediate, or post-fusion conformational state.

Furthermore, the NANOBODIES® ($V_{HH}$ sequences) and polypeptides of the invention may also be directed against an epitope that is located in the stem region and/or in the neck region and/or in the globular head region of a fusion protein. Preferably, the NANOBODIES® ($V_{HH}$ sequences) and polypeptides of the invention are directed against an epitope that is located in the stem region of a fusion protein, such as for instance against an epitope that is located in the region comprising one or more of the amino acids 318 to 322 of the HA1 subunit of influenza HA and/or the region comprising one or more of the amino acids 47 to 58 of the HA2 subunit of influenza HA; against an epitope that is located in the N-terminal region comprising one or more of the amino acids 1 to 38 of the HA2 subunit of influenza HA; against an epitope that is located in the region comprising one or more of the amino acids 38 to 112 of the HA2 subunit of influenza HA; against an epitope that is located in the region comprising one or more of the amino acids 125 to 175 of the HA2 subunit of influenza HA; or against an epitope that is located in the region comprising one or more of the amino acids 176 to 185 of the HA2 subunit of influenza HA. Alternatively, the NANOBODIES® ($V_{HH}$ sequences) and polypeptides of the invention may be directed against an epitope that is located in the globular head of a fusion protein (wherein said globular head may for example comprise a β-barrel-type structure or an immunoglobulin-type β-sandwich domain and a β-sheet domain).

Also, in particular, the NANOBODIES® ($V_{HH}$ sequences) and polypeptides of the invention may preferably be directed against an interaction site, which is chosen from the group consisting of the A-antigenic site and/or amino acids 255 to 280 of the F-protein of RSV virus, the Fla site and/or the region comprising amino acid 389 of the F-protein of RSV virus, amino acids 422 to 438 of the F-protein of RSV virus, sialic acid binding site of the H5 HA envelope protein of influenza virus, the Nicotinic Acetylcholine Receptor (AchR) and/or the Nueral Cell Adhesion Molecule (NCAM) binding site of the G-protein of rabies virus (Thoulouze et al. 1998, J. Virol. 72: 7181-7190).

Finally, the NANOBODIES® ($V_{HH}$ sequences) and polypeptides of the invention may be directed against any epitope that is located in the C-terminal region of a fusion protein and/or in the N-terminal domain of a fusion protein and/or in or comprising the fusion peptide of a fusion protein and/or in the transmembrane domain of a fusion protein and/or in a α-helical coiled-coil of a fusion protein and/or in a β-structure of a fusion protein and/or in Domain I of a fusion protein and/or in Domain II of a fusion protein, such as for example in the fusion peptide of Domain II of a fusion protein, and/or in Domain III of a fusion protein, such as for example in the stem region at the C-terminus of Domain III of a fusion protein or in the transmembrane anchor at the C-terminus of Domain III of a fusion protein.

In one aspect, the NANOBODIES® ($V_{HH}$ sequences) and polypeptides of the invention are directed against the Synagis® binding site on the RSV F protein and/or capable of competing with Synagis® for binding to the RSV F protein. In particular, they may be directed against antigenic site II (also referred to as site A) of the RSV F protein and more preferably against region aa 250-275 of the RSV F protein.

In another aspect, the NANOBODIES® ($V_{HH}$ sequences) and polypeptides of the invention are directed against the 101F binding site on the RSV F protein and/or capable of competing with 101F for binding to the RSV F protein. In particular, they may be directed against antigenic site IV-VI of the RSV F protein and more preferably against region aa 423-436 of the RSV F protein.

In yet another aspect, the NANOBODIES® ($V_{HH}$ sequences) and polypeptides of the invention are directed against the VN04-2 binding site on the hemagglutinin H5 envelope protein of influenza virus and/or capable of competing with VN04-2 for binding to the hemagglutinin H5 envelope protein of influenza virus.

In yet another aspect, the NANOBODIES® ($V_{HH}$ sequences) and polypeptides of the invention are directed against the MAb C179 binding site on the hemagglutinin H5 envelope protein of influenza virus and/or capable of competing with MAb C179 for binding to the hemagglutinin H5 envelope protein of influenza virus.

In yet another aspect, the NANOBODIES® ($V_{HH}$ sequences) and polypeptides of the invention are directed against the MAb 8-2 binding site on G envelope protein of rabies virus and/or capable of competing with MAb 8-2 for binding to the G envelope protein of rabies virus.

Also, the NANOBODIES® ($V_{HH}$ sequences) and polypeptides of the invention may be directed against any other epitope of an envelope protein of a virus (for instance any other epitope that is close to one of the aforementioned epitopes).

Thus, in one preferred, but non-limiting aspect, the NANOBODIES® ($V_{HH}$ sequences) and polypeptides of the invention are generally directed against any epitope or in particular against one of the above-mentioned epitopes of an envelope protein of a virus, and are as further defined herein. For example, said epitope may be present on an envelope protein of a virus that is chosen from the group consisting of the F protein of RSV virus, the G protein of RSV virus, the SH protein of RSV virus, the M protein of RSV virus, the M2 protein of RSV virus, the HA protein of influenza A virus, the gp120 protein of HIV-1 virus, the S1 protein of SARS Corona virus, the gD protein of Herpes simplex 1 virus, the VP1 and/or VP2 and/or VP3 proteins of Poliovirus 1, the VP1 and/or VP2 and/or VP3 proteins of Rhinovirus 3, fibre and/or penton base of Adenovirus 2, σ1 of Reovirus 1, the HEF protein of influenza C virus, the 5 F protein of Simian parainfluenza virus, the F protein of Human parainfluenza virus, the F protein of Newcastle disease virus, the F2 protein of measles, the F2 protein of Sendai virus, the gp2 protein of Ebola virus, the TM protein of Moloney murine leukemia virus, the gp41 protein of Human immunodeficiency virus 1, the gp41 protein of Simian immunodeficiency virus, the gp21 protein of Human T cell leukemia virus 1, the TM protein of Human syncytin-2, the TM protein of Visna virus, the S2 protein of Mouse hepatitis virus, the E2 protein of SARS corona virus, the E protein of Tick-borne encephalitis virus, the E2 protein of Dengue 2 and 3 virus, the E protein of Yellow Fever virus, the E protein of West Nile virus, the E1 protein of Semliki forest virus, the E1 protein of Sindbis virus, the G protein of Rabies virus, the G protein of Vesicular stomatitis virus and the gB protein of Herpes simplex virus.

Accordingly, the NANOBODIES® ($V_{HH}$ sequences) and polypeptides of the invention may be directed against any epitope that is present on an envelope protein of a virus, which is chosen from the group consisting of the F protein of RSV virus, the G protein of RSV virus, the SH protein of RSV virus, the M protein of RSV virus, the M2 protein of RSV virus, the HA protein of influenza A virus, the gp120 protein of HIV-1 virus, the S1 protein of SARS Corona virus, the gD protein of Herpes simplex 1 virus, the VP1 and/or VP2 and/or VP3 proteins of Poliovirus 1, the VP1 and/or VP2 and/or VP3 proteins of Rhinovirus 3, fibre and/or penton base of Adenovirus 2, σ1 of Reovirus 1, the HEF protein of influenza C virus, the 5 F protein of Simian parainfluenza virus, the F protein of Human parainfluenza virus, the F protein of Newcastle disease virus, the F2 protein of measles, the F2 protein of Sendai virus, the gp2 protein of Ebola virus, the TM protein of Moloney murine leukemia virus, the gp41 protein of Human immunodeficiency virus 1, the gp41 protein of Simian immunodeficiency virus, the gp21 protein of Human T cell leukemia virus 1, the TM protein of Human syncytin-2, the TM protein of Visna virus, the S2 protein of Mouse hepatitis virus, the E2 protein of SARS corona virus, the E protein of Tick-borne encephalitis virus, the E2 protein of Dengue 2 and 3 virus, the E protein of Yellow Fever virus, the E protein of West Nile virus, the E1 protein of Semliki forest virus, the E1 protein of Sindbis virus, the G protein of Rabies virus, the G protein of Vesicular stomatitis virus and the gB protein of Herpes simplex virus.

As already described herein, the amino acid sequence and structure of a NANOBODY® ($V_{HH}$ sequence) can be considered—without however being limited thereto—to be comprised of four framework regions or "FR's" (or sometimes also referred to as "FW's"), which are referred to in the art and herein as "Framework region 1" or "FR1"; as "Framework region 2" or "FR2"; as "Framework region 3" or "FR3"; and as "Framework region 4" or "FR4", respectively; which framework regions are interrupted by three complementary determining regions or "CDR's", which are referred to in the art as "Complementarity Determining Region 1" or "CDR1"; as "Complementarity Determining Region 2" or "CDR2"; and as "Complementarity Determining Region 3" or "CDR3", respectively. Some preferred framework sequences and CDR's (and combinations thereof) that are present in the NANOBODIES® ($V_{HH}$ sequences) of the invention are as described herein. Other suitable CDR sequences can be obtained by the methods described herein.

According to a non-limiting but preferred aspect of the invention, (the CDR sequences present in) the NANOBODIES® ($V_{HH}$ sequences) of the invention are such that:

- the NANOBODIES® ($V_{HH}$ sequences) can bind to an envelope protein of a virus with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);

and/or such that:

the NANOBODIES® ($V_{HH}$ sequences) can bind to an envelope protein of a virus with a $k_{on}$-rate of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$;

and/or such that they:

the NANOBODIES® ($V_{HH}$ sequences) can bind to an envelope protein of a virus with a $k_{off}$ rate between 1 $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Preferably, (the CDR sequences present in) the NANOBODIES® ($V_{HH}$ sequences) of the invention are such that: a monovalent NANOBODY® ($V_{HH}$ sequence) of the invention (or a polypeptide that contains only one NANOBODY® ($V_{HH}$ sequence) of the invention) is preferably such that it will bind to an envelope protein of a virus with an affinity less than 500 nM, preferably less than 200 nM, more preferably less than 10 nM, such as less than 500 pM.

The affinity of the NANOBODY® ($V_{HH}$ sequence) of the invention against an envelope protein of a virus can be determined in a manner known per se, for example using the general techniques for measuring $K_D$. $K_A$, $k_{off}$ or $k_{on}$ mentioned herein, as well as some of the specific assays described herein.

Some preferred IC50 values for binding of the NANOBODIES® ($V_{HH}$ sequences) of the invention (and of polypeptides comprising the same) to an envelope protein of a virus will become clear from the further description and examples herein.

In a preferred but non-limiting aspect, the invention relates to a NANOBODY® ($V_{HH}$ sequence) (as defined herein) against an envelope protein of a virus, which consists of 4 framework regions (FR1 to FR4 respectively) and 3 complementarity determining regions (CDR1 to CDR3 respectively), in which:

CDR1 is chosen from the group consisting of:

a) the amino acid sequences of SEQ ID NO's: 690 to 971, 2467 to 2484, 2590 to 2597, 2754 to 2789 and 3194 to 3258;

b) amino acid sequences that have at least 80% amino acid identity with at least one of the amino acid sequences of SEQ ID NO's: 690 to 971, 2467 to 2484, 2590 to 2597, 2754 to 2789 and 3194 to 3258;

c) amino acid sequences that have 3, 2, or 1 amino acid difference with at least one of the amino acid sequences of SEQ ID NO's: 690 to 971, 2467 to 2484, 2590 to 2597, 2754 to 2789 and 3194 to 3258;

and/or

CDR2 is chosen from the group consisting of:

d) the amino acid sequences of SEQ ID NO's: 1254 to 1535, 2503 to 2520, 2606 to 2613, 2826 to 2861 and 3324 to 3388;

e) amino acid sequences that have at least 80% amino acid identity with at least one of the amino acid sequences of SEQ ID NO's: 1254 to 1535, 2503 to 2520, 2606 to 2613, 2826 to 2861 and 3324 to 3388;

f) amino acid sequences that have 3, 2, or 1 amino acid difference with at least one of the amino acid sequences of SEQ ID NO's: 1254 to 1535, 2503 to 2520, 2606 to 2613, 2826 to 2861 and 3324 to 3388;

and/or

CDR3 is chosen from the group consisting of:

g) the amino acid sequences of SEQ ID NO's: 1818 to 2099, 2539 to 2556, 2622 to 2629, 2898 to 2933 and 3454 to 3518;

h) amino acid sequences that have at least 80% amino acid identity with at least one of the amino acid sequences of SEQ ID NO's: 1818 to 2099, 2539 to 2556, 2622 to 2629, 2898 to 2933 and 3454 to 3518;

i) amino acid sequences that have 3, 2, or 1 amino acid difference with at least one of the amino acid sequences of SEQ ID NO's: 1818 to 2099, 2539 to 2556, 2622 to 2629, 2898 to 2933 and 3454 to 3518;

or any suitable fragment of such an amino acid sequence.

In particular, according to this preferred but non-limiting aspect, the invention relates to a NANOBODY® ($V_{HH}$ sequence) (as defined herein) against an envelope protein of a virus, which consists of 4 framework regions (FR1 to FR4 respectively) and 3 complementarity determining regions (CDR1 to CDR3 respectively), in which:

CDR1 is chosen from the group consisting of:

a) the amino acid sequences of SEQ ID NO's: 690 to 971, 2467 to 2484, 2590 to 2597, 2754 to 2789 and 3194 to 3258;

b) amino acid sequences that have at least 80% amino acid identity with at least one of the amino acid sequences of SEQ ID NO's: 690 to 971, 2467 to 2484, 2590 to 2597, 2754 to 2789 and 3194 to 3258;

c) amino acid sequences that have 3, 2, or 1 amino acid difference with at least one of the amino acid sequences of SEQ ID NO's: 690 to 971, 2467 to 2484, 2590 to 2597, 2754 to 2789 and 3194 to 3258;

and

CDR2 is chosen from the group consisting of:

d) the amino acid sequences of SEQ ID NO's: 1254 to 1535, 2503 to 2520, 2606 to 2613, 2826 to 2861 and 3324 to 3388;

e) amino acid sequences that have at least 80% amino acid identity with at least one of the amino acid sequences of SEQ ID NO's: 1254 to 1535, 2503 to 2520, 2606 to 2613, 2826 to 2861 and 3324 to 3388;

f) amino acid sequences that have 3, 2, or 1 amino acid difference with at least one of the amino acid sequences of SEQ ID NO's: 1254 to 1535, 2503 to 2520, 2606 to 2613, 2826 to 2861 and 3324 to 3388;

and

CDR3 is chosen from the group consisting of:

g) the amino acid sequences of SEQ ID NO's: 1818 to 2099, 2539 to 2556, 2622 to 2629, 2898 to 2933 and 3454 to 3518;

h) amino acid sequences that have at least 80% amino acid identity with at least one of the amino acid sequences of SEQ ID NO's: 1818 to 2099, 2539 to 2556, 2622 to 2629, 2898 to 2933 and 3454 to 3518;

i) amino acid sequences that have 3, 2, or 1 amino acid difference with at least one of the amino acid sequences of SEQ ID NO's: 1818 to 2099, 2539 to 2556, 2622 to 2629, 2898 to 2933 and 3454 to 3518;

or any suitable fragment of such an amino acid sequences.

In a more specifically preferred but non-limiting aspect, the invention relates to a NANOBODY® ($V_{HH}$ sequence) (as defined herein) against the F-protein of human RSV virus, which consists of 4 framework regions (FR1 to FR4 respectively) and 3 complementarity determining regions (CDR1 to CDR3 respectively), in which:

CDR1 is chosen from the group consisting of:

a) the amino acid sequences of SEQ ID NO's: 722 to 800, 812 to 971, 2484 and 2590 to 2597;

b) amino acid sequences that have at least 80% amino acid identity with at least one of the amino acid sequences of SEQ ID NO's: 722 to 800, 812 to 971, 2484 and 2590 to 2597;

c) amino acid sequences that have 3, 2, or 1 amino acid difference with at least one of the amino acid sequences of SEQ ID NO's: 722 to 800, 812 to 971, 2484 and 2590 to 2597; and/or CDR2 is chosen from the group consisting of:

d) the amino acid sequences of SEQ ID NO's: 1286 to 1364, 1376 to 1535, 2520 and 2606 to 2613;

e) amino acid sequences that have at least 80% amino acid identity with at least one of the amino acid sequences of SEQ ID NO's: 1286 to 1364, 1376 to 1535, 2520 and 2606 to 2613;

f) amino acid sequences that have 3, 2, or 1 amino acid difference with at least one of the amino acid sequences of SEQ ID NO's: 1286 to 1364, 1376 to 1535, 2520 and 2606 to 2613;

and/or

CDR3 is chosen from the group consisting of:

g) the amino acid sequences of SEQ ID NO's: 1850 to 1928, 1940 to 2099, 2556 and 2622 to 2629;

h) amino acid sequences that have at least 80% amino acid identity with at least one of the amino acid sequences of SEQ ID NO's: 1850 to 1928, 1940 to 2099, 2556 and 2622 to 2629;

i) amino acid sequences that have 3, 2, or 1 amino acid difference with at least one of the amino acid sequences of SEQ ID NO's: 1850 to 1928, 1940 to 2099, 2556 and 2622 to 2629;

or any suitable fragment of such an amino acid sequence.

In particular, according to this preferred but non-limiting aspect, the invention relates to a NANOBODY® ($V_{HH}$ sequence) (as defined herein) against the F-protein of human RSV virus, which consists of 4 framework regions (FR1 to FR4 respectively) and 3 complementarity determining regions (CDR1 to CDR3 respectively), in which:

CDR1 is chosen from the group consisting of:

a) the amino acid sequences of SEQ ID NO's: 722 to 800, 812 to 971, 2484 and 2590 to 2597;

b) amino acid sequences that have at least 80% amino acid identity with at least one of the amino acid sequences of SEQ ID NO's: 722 to 800, 812 to 971, 2484 and 2590 to 2597;

c) amino acid sequences that have 3, 2, or 1 amino acid difference with at least one of the amino acid sequences of SEQ ID NO's: 722 to 800, 812 to 971, 2484 and 2590 to 2597;

and

CDR2 is chosen from the group consisting of:

d) the amino acid sequences of SEQ ID NO's: 1286 to 1364, 1376 to 1535, 2520 and 2606 to 2613;

e) amino acid sequences that have at least 80% amino acid identity with at least one of the amino acid sequences of SEQ ID NO's: 1286 to 1364, 1376 to 1535, 2520 and 2606 to 2613;

f) amino acid sequences that have 3, 2, or 1 amino acid difference with at least one of the amino acid sequences of SEQ ID NO's: 1286 to 1364, 1376 to 1535, 2520 and 2606 to 2613;

and

CDR3 is chosen from the group consisting of:

g) the amino acid sequences of SEQ ID NO's: 1850 to 1928, 1940 to 2099, 2556 and 2622 to 2629;

h) amino acid sequences that have at least 80% amino acid identity with at least one of the amino acid sequences of SEQ ID NO's: 1850 to 1928, 1940 to 2099, 2556 and 2622 to 2629;

i) amino acid sequences that have 3, 2, or 1 amino acid difference with at least one of the amino acid sequences of SEQ ID NO's: 1850 to 1928, 1940 to 2099, 2556 and 2622 to 2629;

or any suitable fragment of such an amino acid sequences.

Yet, in another specifically preferred but non-limiting aspect, the invention relates to a NANOBODY® ($V_{HH}$ sequence) (as defined herein) against hemagglutinin of influenza virus, and more specifically hemagglutinin H5 of influenza virus, which consists of 4 framework regions (FR1 to FR4 respectively) and 3 complementarity determining regions (CDR1 to CDR3 respectively), in which:

CDR1 is chosen from the group consisting of:

a) the amino acid sequences of SEQ ID NO's: 690 to 721, 2467 to 2483, 2754 to 2755 and 3194 to 3258;

b) amino acid sequences that have at least 80% amino acid identity with at least one of the amino acid sequences of SEQ ID NO's: 690 to 721, 2467 to 2483, 2754 to 2755 and 3194 to 3258;

c) amino acid sequences that have 3, 2, or 1 amino acid difference with at least one of the amino acid sequences of SEQ ID NO's: 690 to 721, 2467 to 2483, 2754 to 2755 and 3194 to 3258;

and/or

CDR2 is chosen from the group consisting of:

d) the amino acid sequences of SEQ ID NO's: 1254 to 1285, 2503 to 2519, 2826 to 2827 and 3324 to 3388;

e) amino acid sequences that have at least 80% amino acid identity with at least one of the amino acid sequences of SEQ ID NO's: 1254 to 1285, 2503 to 2519, 2826 to 2827 and 3324 to 3388;

f) amino acid sequences that have 3, 2, or 1 amino acid difference with at least one of the amino acid sequences of SEQ ID NO's: 1254 to 1285, 2503 to 2519, 2826 to 2827 and 3324 to 3388;

and/or

CDR3 is chosen from the group consisting of:

g) the amino acid sequences of SEQ ID NO's: 1818 to 1849, 2539 to 2555, 2898 to 2899 and 3454 to 3518;

h) amino acid sequences that have at least 80% amino acid identity with at least one of the amino acid sequences of SEQ ID NO's: 1818 to 1849, 2539 to 2555, 2898 to 2899 and 3454 to 3518;

i) amino acid sequences that have 3, 2, or 1 amino acid difference with at least one of the amino acid sequences of SEQ ID NO's: 1818 to 1849, 2539 to 2555, 2898 to 2899 and 3454 to 3518;

or any suitable fragment of such an amino acid sequence.

In particular, according to this preferred but non-limiting aspect, the invention relates to a NANOBODY® ($V_{HH}$ sequence) (as defined herein) against hemagglutinin of influenza virus, and more specifically hemagglutinin H5 of influenza virus, which consists of 4 framework regions (FR1 to FR4 respectively) and 3 complementarity determining regions (CDR1 to CDR3 respectively), in which:

CDR1 is chosen from the group consisting of:

a) the amino acid sequences of SEQ ID NO's: 690 to 721, 2467 to 2483, 2754 to 2755 and 3194 to 3258;

b) amino acid sequences that have at least 80% amino acid identity with at least one of the amino acid sequences of SEQ ID NO's: 690 to 721, 2467 to 2483, 2754 to 2755 and 3194 to 3258;

c) amino acid sequences that have 3, 2, or 1 amino acid difference with at least one of the amino acid sequences of SEQ ID NO's: 690 to 721, 2467 to 2483, 2754 to 2755 and 3194 to 3258;

and

CDR2 is chosen from the group consisting of:

d) the amino acid sequences of SEQ ID NO's: 1254 to 1285, 2503 to 2519, 2826 to 2827 and 3324 to 3388;

e) amino acid sequences that have at least 80% amino acid identity with at least one of the amino acid sequences of SEQ ID NO's: 1254 to 1285, 2503 to 2519, 2826 to 2827 and 3324 to 3388;

f) amino acid sequences that have 3, 2, or 1 amino acid difference with at least one of the amino acid sequences of SEQ ID NO's: 1254 to 1285, 2503 to 2519, 2826 to 2827 and 3324 to 3388;

and

CDR3 is chosen from the group consisting of:

g) the amino acid sequences of SEQ ID NO's: 1818 to 1849, 2539 to 2555, 2898 to 2899 and 3454 to 3518;

h) amino acid sequences that have at least 80% amino acid identity with at least one of the amino acid sequences of SEQ ID NO's: 1818 to 1849, 2539 to 2555, 2898 to 2899 and 3454 to 3518;

i) amino acid sequences that have 3, 2, or 1 amino acid difference with at least one of the amino acid sequences of SEQ ID NO's: 1818 to 1849, 2539 to 2555, 2898 to 2899 and 3454 to 3518;

or any suitable fragment of such an amino acid sequences.

Finally, in yet another specifically preferred but non-limiting aspect, the invention relates to a NANOBODY® ($V_{HH}$ sequence) (as defined herein) against the G-protein of rabies virus, which consists of 4 framework regions (FR1 to FR4 respectively) and 3 complementarity determining regions (CDR1 to CDR3 respectively), in which:

CDR1 is chosen from the group consisting of:

a) the amino acid sequences of SEQ ID NO's: 801 to 811 and 2756 to 2789;

b) amino acid sequences that have at least 80% amino acid identity with at least one of the amino acid sequences of SEQ ID NO's: 801 to 811 and 2756 to 2789;

c) amino acid sequences that have 3, 2, or 1 amino acid difference with at least one of the amino acid sequences of SEQ ID NO's: 801 to 811 and 2756 to 2789;

and/or

CDR2 is chosen from the group consisting of:

d) the amino acid sequences of SEQ ID NO's: 1365 to 1375 and 2828 to 2861;

e) amino acid sequences that have at least 80% amino acid identity with at least one of the amino acid sequences of SEQ ID NO's: 1365 to 1375 and 2828 to 2861;

f) amino acid sequences that have 3, 2, or 1 amino acid difference with at least one of the amino acid sequences of SEQ ID NO's: 1365 to 1375 and 2828 to 2861;

and/or

CDR3 is chosen from the group consisting of:

g) the amino acid sequences of SEQ ID NO's: 1929 to 1939 and 2900 to 2933;

h) amino acid sequences that have at least 80% amino acid identity with at least one of the amino acid sequences of SEQ ID NO's: 1929 to 1939 and 2900 to 2933;

i) amino acid sequences that have 3, 2, or 1 amino acid difference with at least one of the amino acid sequences of SEQ ID NO's: 1929 to 1939 and 2900 to 2933;

or any suitable fragment of such an amino acid sequence.

In particular, according to this preferred but non-limiting aspect, the invention relates to a NANOBODY® ($V_{HH}$ sequence) (as defined herein) against the G-protein of rabies virus, which consists of 4 framework regions (FR1 to FR4 respectively) and 3 complementarity determining regions (CDR1 to CDR3 respectively), in which:

CDR1 is chosen from the group consisting of:

a) the amino acid sequences of SEQ ID NO's: 801 to 811 and 2756 to 2789;

b) amino acid sequences that have at least 80% amino acid identity with at least one of the amino acid sequences of SEQ ID NO's: 801 to 811 and 2756 to 2789;

c) amino acid sequences that have 3, 2, or 1 amino acid difference with at least one of the amino acid sequences of SEQ ID NO's: 801 to 811 and 2756 to 2789;

and

CDR2 is chosen from the group consisting of:

d) the amino acid sequences of SEQ ID NO's: 1365 to 1375 and 2828 to 2861;

e) amino acid sequences that have at least 80% amino acid identity with at least one of the amino acid sequences of SEQ ID NO's: 1365 to 1375 and 2828 to 2861;

f) amino acid sequences that have 3, 2, or 1 amino acid difference with at least one of the amino acid sequences of SEQ ID NO's: 1365 to 1375 and 2828 to 2861;

and

CDR3 is chosen from the group consisting of:

g) the amino acid sequences of SEQ ID NO's: 1929 to 1939 and 2900 to 2933;

h) amino acid sequences that have at least 80% amino acid identity with at least one of the amino acid sequences of SEQ ID NO's: 1929 to 1939 and 2900 to 2933;

i) amino acid sequences that have 3, 2, or 1 amino acid difference with at least one of the amino acid sequences of SEQ ID NO's: 1929 to 1939 and 2900 to 2933;

or any suitable fragment of such an amino acid sequences.

As generally mentioned herein for the amino acid sequences of the invention, when a NANOBODY® ($V_{HH}$ sequence) of the invention contains one or more CDR1 sequences according to b) and/or c):

i) any amino acid substitution in such a CDR according to b) and/or c) is preferably, and compared to the corresponding CDR according to a), a conservative amino acid substitution (as defined herein);

and/or ii) the CDR according to b) and/or c) preferably only contains amino acid substitutions, and no amino acid deletions or insertions, compared to the corresponding CDR according to a);

and/or iii) the CDR according to b) and/or c) may be a CDR that is derived from a CDR according to a) by means of affinity maturation using one or more techniques of affinity maturation known per se.

Similarly, when a NANOBODY® ($V_{HH}$ sequence) of the invention contains one or more CDR2 sequences according to e) and/or f):

i) any amino acid substitution in such a CDR according to e) and/or f) is preferably, and compared to the corresponding CDR according to d), a conservative amino acid substitution (as defined herein);

and/or ii) the CDR according to e) and/or f) preferably only contains amino acid substitutions, and no amino acid deletions or insertions, compared to the corresponding CDR according to d);

and/or iii) the CDR according to e) and/or f) may be a CDR that is derived from a CDR according to d) by means of affinity maturation using one or more techniques of affinity maturation known per se.

Also, similarly, when a NANOBODY® ($V_{HH}$ sequence) of the invention contains one or more CDR3 sequences according to h) and/or i):

i) any amino acid substitution in such a CDR according to h) and/or i) is preferably, and compared to the corresponding CDR according to g), a conservative amino acid substitution (as defined herein);

and/or ii) the CDR according to h) and/or i) preferably only contains amino acid substitutions, and no amino acid deletions or insertions, compared to the corresponding CDR according to g);

and/or iii) the CDR according to h) and/or i) may be a CDR that is derived from a CDR according to g) by means of affinity maturation using one or more techniques of affinity maturation known per se.

It should be understood that the last three paragraphs generally apply to any NANOBODY® ($V_{HH}$ sequence) of the invention that comprises one or more CDR1 sequences, CDR2 sequences and/or CDR3 sequences according to b), c), e), f), h) or i), respectively.

Of the NANOBODIES® ($V_{HH}$ sequences) of the invention, NANOBODIES® ($V_{HH}$ sequences) comprising one or more of the CDR's explicitly listed above are particularly preferred; NANOBODIES® ($V_{HH}$ sequences) comprising two or more of the CDR's explicitly listed above are more particularly preferred; and NANOBODIES® ($V_{HH}$ sequences) comprising three of the CDR's explicitly listed above are most particularly preferred.

Some particularly preferred, but non-limiting combinations of CDR sequences, as well as preferred combinations of CDR sequences and framework sequences, are mentioned in Table B-1 below, which lists the CDR sequences and framework sequences that are present in a number of preferred (but non-limiting) NANOBODIES® ($V_{HH}$ sequences) of the invention. As will be clear to the skilled person, a combination of CDR1, CDR2 and CDR3 sequences that occur in the same clone (i.e. CDR1, CDR2 and CDR3 sequences that are mentioned on the same line in Table B-1) will usually be preferred (although the invention in its broadest sense is not limited thereto, and also comprises other suitable combinations of the CDR sequences mentioned in Table B-1). Also, a combination of CDR sequences and framework sequences that occur in the same clone (i.e. CDR sequences and framework sequences that are mentioned on the same line in Table B-1) will usually be preferred (although the invention in its broadest sense is not limited thereto, and also comprises other suitable combinations of the CDR sequences and framework sequences mentioned in Table B-1, as well as combinations of such CDR sequences and other suitable framework sequences, e.g. as further described herein).

Also, in the NANOBODIES® ($V_{HH}$ sequences) of the invention that comprise the combinations of CDR's mentioned in Table B-1, each CDR can be replaced by a CDR chosen from the group consisting of amino acid sequences that have at least 80%, preferably at least 90%, more preferably at least 95%, even more preferably at least 99% sequence identity (as defined herein) with the mentioned CDR's; in which:

i) any amino acid substitution in such a CDR is preferably, and compared to the corresponding CDR sequence mentioned in Table B-1, a conservative amino acid substitution (as defined herein);

and/or ii) any such CDR sequence preferably only contains amino acid substitutions, and no amino acid deletions or insertions, compared to the corresponding CDR sequence mentioned in Table B-1;

and/or iii) any such CDR sequence is a CDR that is derived by means of a technique for affinity maturation known per se, and in particular starting from the corresponding CDR sequence mentioned in Table B-1.

However, as will be clear to the skilled person, the (combinations of) CDR sequences, as well as (the combinations of) CDR sequences and framework sequences mentioned in Table B-1 will generally be preferred.

TABLE B-1

Preferred combinations of CDR sequences, preferred combinations of framework sequences, and preferred combinations of framework and CDR sequences.

| Clone | ID | FR1 | ID | CDR1 | ID | FR2 | ID | CDR2 |
|---|---|---|---|---|---|---|---|---|
| LG202A10 | 126 | EVQLVESGG GLVQAGDSLR LSCIDSGRTFS | 408 | DYPIG | 690 | WFRQAP GKEREF VA | 972 | AIYAIGG DVYYAD SVKG |
| LG202A12 | 127 | EVQLVESGG GLVQAGGSL RLSCAASGGT | 409 | SYAMG | 691 | WFRQAP GKERDF VS | 973 | AITWSG GSTYYA DSVKG |
| LG202A5 | 128 | EVQLVESGG DLVQPGGSLR LSCAASGFTFR | 410 | GYWMT | 692 | WVRQAP GKGLEW VS | 974 | SINNIGE EAYYVD SVKG |
| LG202A9 | 129 | EVQLVESGG GSVQPGGSL RLSCAASGFT FR | 411 | GYWMS | 693 | WVRQAP GKGLEW VS | 975 | AINNVG GDTYYA DSVKG |
| LG202B10 | 130 | EVQLVESGG GLVQPGGSL RLSCAASGFT FR | 412 | GYWMS | 694 | WVRQAP GKGLEW VS | 976 | AINNVG DEVYYA DSVKG |

TABLE B-1-continued

Preferred combinations of CDR sequences, preferred combinations of framework sequences, and preferred combinations of framework and CDR sequences.

| | | | | | | | | |
|---|---|---|---|---|---|---|---|---|
| LG202B7 | 131 | EVQLVESGG GLVQPGGSL RLSCAASGFT FR | 413 | GYWMS | 695 | WVRQAP GKGLEW VS | 977 | AINNVG DEVYYA DSVKG |
| LG202B8 | 132 | EVQLVESGG GLVQPGGSL RLSCAASGFT FS | 414 | GYWMS | 696 | WVRQAP GKGLEW VS | 978 | AISNSG GETYYA DSVKG |
| LG202B9 | 133 | EVQLVESGG GSVQPGGSL RLSCAASGFT FR | 415 | GYWMS | 697 | WVRQAP GKGLEW VS | 979 | AINNLGG DTYYAD SVKG |
| LG202C1 | 134 | KVQLVESGG DLVQPGGSLR LSCAASGFTFR | 416 | GYWMT | 698 | WVRQAP GKGLEW VS | 980 | SINNIGE EAYYVD SVKG |
| LG202C11 | 135 | EVQLVESGG GSVQPGGSL RLSCAASGFT FR | 417 | GYWMS | 699 | WVRQAP GKGLEW VS | 981 | AINNVG GDTYYA DSVKG |
| LG202C2 | 136 | EVQLVESGG DLVQPGGSLR LSCAASGFTFR | 418 | GYWMT | 700 | WVRQAP GKGLEW VS | 982 | SINNIGE EAYYVD SVKG |
| LG202C7 | 137 | EVQLVESGG GLVQPGGSL RLSCAASGFT FS | 419 | GYWMS | 701 | WVRQAP GKGLEW VS | 983 | AINNVG DETYYA NSVKG |
| LG202C8 | 138 | EVQLVESGG GLVQPGGSL RLSCTGSGFT FS | 420 | SYWMD | 702 | WVRQTP GKDLEY VS | 984 | GISPSGS NTDYAD SVKG |
| LG202C9 | 139 | EVQLVESGG GLVQPGGSL RLSCAASGFT FR | 421 | GYWMS | 703 | WVRQAP GKGLEW VS | 985 | AINNVG GETYYA DSVKG |
| LG202D5 | 140 | EVQLVESGG GLVQAGGSL RLSCAASGST GS | 422 | STAMG | 704 | WSRQAP GKQRE WVA | 986 | SISSAGT IRYVDSV KG |
| LG202D7 | 141 | EVQLVESGG GSVQPGGSL RLSCAASGFT FR | 423 | GYWMS | 705 | WVRQAP GKGLEW VS | 987 | AINNLGG DTYYAD SVKG |
| LG202D8 | 142 | EVQLVESGG GLVQPGGSL RLSCAASGFT FR | 424 | GYWMS | 706 | WVRQAP GKGLEW VS | 988 | AINNVG DEVYYA DSVKG |
| LG202E11 | 143 | EVQLVESGG GLVQPGGSL RLSCAASGFT FR | 425 | GYWMS | 707 | WVRQAP GKGLEW VS | 989 | AINNVG DEVYYA DSVKG |
| LG202E2 | 144 | EVQLVESGG GLVQPGGSL RLSCAASGFT FG | 426 | GYWMT | 708 | WVRQAP GKGLEW VS | 990 | SIANDGK STYYVD SVKG |
| LG202E5 | 145 | EVQLVESGG DLVQPGGSLR LSCAASGFTFR | 427 | GYWMT | 709 | WVRQAP GKGLEW VS | 991 | SINNIGE ETYYVD SVKG |
| LG202E6 | 146 | EVQLVESGG GLVQAGGSL RLSCAASGRT FS | 428 | SYAMG | 710 | WFRQAP GKEREF VA | 992 | AISWSG RTTYYA DFVKG |

TABLE B-1-continued

Preferred combinations of CDR sequences, preferred combinations of framework sequences, and preferred combinations of framework and CDR sequences.

| | | | | | | | | |
|---|---|---|---|---|---|---|---|---|
| LG202E7 | 147 | EVQLVESGGGLVQPGGSLRLSCAASGFTFR | 429 | GYWMS | 711 | WVRQAPGKGLEWVS | 993 | AINNVGGETYYADSVKG |
| LG202F10 | 148 | EVQLVESGGGSVQPGGSLRLSCAASGFTFR | 430 | GYWMS | 712 | WVRQAPGKGLEWVS | 994 | AINNLGGDTYYADSVKG |
| LG202F12 | 149 | EVQLVESGGGLVQPGGSLRLSCAASGFTFS | 431 | GYWMS | 713 | WVRQAPGKGLEWVS | 995 | AINNVGGDTYYADSVKG |
| LG202F3 | 150 | EVQLVESGGDLVQPGGSLRLSCAASGFTFR | 432 | GYWMT | 714 | WVRQAPGKGLEWVS | 996 | SINNIGEEAYYVDSVKG |
| LG202F4 | 151 | EVQLVESGGDLVQPGGSLRLSCAASGFTFR | 433 | GYWMT | 715 | WVRQAPGKGLEWVS | 997 | SINNIGEEAYYVDSVKG |
| LG202F8 | 152 | EVQLVESGGGLVQPGGSLRLSCAASGLIFS | 434 | SYDMG | 716 | WFRQAPGEERAFVG | 998 | AISRSGDVRYVDPVKG |
| LG202G11 | 153 | EVQLVESGGGLVQPGGSLRLSCAASGFTFR | 435 | GYWMS | 717 | WVRQAPGKGLEWVS | 999 | AINNVGGETYYADSVKG |
| LG202G3 | 154 | EVQLMESGGGLVQAGGSLRLSCAASGRTFS | 436 | GYTMG | 718 | WFRQAPGKGREWVA | 1000 | GISWSGDSTYYADSVKG |
| LG202G8 | 155 | EVQLVESGGGSVQPGGSLRLSCAASGFTFR | 437 | GYWMS | 719 | WVRQAPGKGLEWVS | 1001 | AINNLGGDTYYADSVKG |
| LG202H2 | 156 | EVQLVESGGDLVQPGGSLRLSCAASGFTFS | 438 | GYWMT | 720 | WVRQAPGKGLEWVS | 1002 | SINNIGEEVYYVDSVKG |
| LG202H8 | 157 | EVQLVESGGGSVQPGGSLRLSCAASGFTFR | 439 | GYWMS | 721 | WVRQAPGKGLEWVS | 1003 | AINNVGGDTYYADSVKG |
| LG191B9 | 158 | EVQLVESGGGLVQAGGSLRLSCAASGRTFS | 440 | SSFMA | 722 | WFRQVLGSDREFVG | 1004 | GISPGGRFTYYADSRKG |
| LG191D3 | 159 | EVQLVESGGGLVQAGGSLRLSCEASGRTYS | 441 | RYGMG | 723 | WFRQAPGKEREFVA | 1005 | AVSRLSGPRTVYADSVKG |
| LG192A8 | 160 | EVQLVESGGGLVQAGGSLRLSCAASERTVI | 442 | AYTMG | 724 | WFRRAPGKERDFVA | 1006 | AMNWNGGNTIYADSAKG |
| LG192B1 | 161 | EVQLVESGGGLVQPGGSLRLSCAASGLTFR | 443 | NYAIG | 725 | WFRQAPGKEREGVS | 1007 | CINSGGSITDYLDSVKG |
| LG192C10 | 162 | EVQLVESGGGLVQAGGSLRLSCAASEGYFR | 444 | NYMVG | 726 | WFRQAPGGERMFVA | 1008 | AISDTAYYADSVKG |

TABLE B-1-continued

Preferred combinations of CDR sequences, preferred combinations of framework sequences, and preferred combinations of framework and CDR sequences.

| | | | | | | | | |
|---|---|---|---|---|---|---|---|---|
| LG192C4 | 163 | EVQLVESGG GLVQAGGSL RLSCEASGRT FS | 445 | SYAMVG | 727 | WFRQAP GKEREF VA | 1009 | AVTRWS GARTVY ADSVKG |
| LG192C6 | 164 | EVQLVESGG GLVQAGGSL RLSCEASGRT ER | 446 | YQAMG | 728 | WFRQAP GKEREF VA | 1010 | VVTRWS GARTVY ADSVKG |
| LG192D3 | 165 | EVQLVESGG GLVQAGGSL RLSCATSGRT RS | 447 | RYTMG | 729 | WFRQAP GKEREF VA | 1011 | AISWSD DSTYYR DSVKG |
| LG191E4 | 166 | EVQLVESGG GLVQAGGSL RLSCAASGPT FS | 448 | ADTMG | 730 | WFRQAP GKEREF VA | 1012 | TIPWSG GIAYYSD SVKG |
| LG192F2 | 167 | EVQLVESGG GLVQAGGSL RLSCEASGRT FS | 449 | PIAMG | 731 | WFRQAP GKEREF VA | 1013 | VVTRWS GARTVY ADSVKG |
| LG192H1 | 168 | EVQLVESGG GLVQAGGSL RLSCAASGIIFS | 450 | TNHMG | 732 | WYRRAP GKQREL VG | 1014 | TINRGDS PYYADS VKG |
| LG192H2 | 169 | EVQLVESGG GLVQAGGSL RLSCEASGRT FS | 451 | NYAMG | 733 | WFRQAP GKEREF VA | 1015 | VVTRWS GGRTVY ADSVKG |
| LG20610B | 170 | EVQLVESGG GLVQAGGSL RLSCTASGRT FS | 452 | SYAMG | 734 | WFRQTP GKEREF VA | 1016 | SISWIGK FTYYAD SVKG |
| LG20610C | 171 | EVQLVESGG GLVQTGGSLR LSCAASGRTFS | 453 | SSFMA | 735 | WFRQAL GSDREF VG | 1017 | GISPGG RITYYAD SRKG |
| LG20610D | 172 | EVQLVESGG GLVQTGGSLR LSCAASGRTFS | 454 | SSFMA | 736 | WFRQAL GSDREF VG | 1018 | GISPGG RITYYAD SRKG |
| LG20610E | 173 | EVQLVESGG GLVQAGGSL RLSCAASVRT FS | 455 | NGAMG | 737 | WFRQAP GKEREF VA | 1019 | SISWSG GSTYYA DSVKG |
| LG20610F | 174 | EVQLVESGG GLVQAGGSL RLSCAASERT VI | 456 | AYTMG | 738 | WFRRAP GKERDF VA | 1020 | AMNWN GGNTIYA DSAKG |
| LG20611D | 175 | EVQLVESGG GLVQAGGSL RLSCAASERT VI | 457 | AYTMG | 739 | WFRRAP GKERDF VA | 1021 | AMNWN GGNTIYA DSAKG |
| LG20611H | 176 | EVQLVESGG GLVQAGGSL RLSCAASEGY FR | 458 | NYMVG | 740 | WFRQAP GGERMF VA | 1022 | AISDTAY YADSVKG |
| LG20612F | 177 | EVQLVESGG GLVQAGGSL RLSCAASEGY FR | 459 | NYMVG | 741 | WFRQAP GGERMF VA | 1023 | AISDTAY YADSVKG |
| LG2062A | 178 | EVQLVESGG GLVQAGGSL RLSCEASGRT FS | 460 | NYAMG | 742 | WFRQAP GKEREF VA | 1024 | VVTRWS GGRTVY ADSVKG |

TABLE B-1-continued

Preferred combinations of CDR sequences, preferred combinations of framework sequences, and preferred combinations of framework and CDR sequences.

| | | | | |
|---|---|---|---|---|
| LG2062C | 179 EVQLVESGGE LVQAGDSLTV SCAASGRTFS | 461 VYTMG | 743 WFRQAP MKEREF VA | 1025 AISGGSI RYADSV KG |
| LG2062E | 180 EVQLVESGG GLVQPGGSL RLSCAASGFT FS | 462 SYWMY | 744 WVRQAP GKGLEW VS | 1026 AISTGG GDTHYA DSVKG |
| LG2062F | 181 EVQLVESGG GLVQAGGSL RLSCEASGRT YS | 463 RYGMG | 745 WFRQAP GKEREF VA | 1027 AVSRLS GPRTVY ADSVKG |
| LG2062G | 182 EVQLVESGG GLVQPGGSL RLSCAASGSS FS | 464 INAMG | 746 WFRQAP GKEREF VA | 1028 VVTRWS GARTVY ADSVKG |
| LG2062H | 183 EVQLVESGG GLVQPGGSL RLSCAASGSS FS | 465 INAMG | 747 WFRQAP GKEREF VA | 1029 VVTRWS GARTVY ADSVKG |
| LG2063A | 184 EMQLVESGG GLVQAGGSL RLSCEASGRS FS | 466 SYAMG | 748 WFRQAP GKEREF VA | 1030 AVSRWS GPRTVY ADSVKG |
| LG2063B | 185 EVQLVESGG GLVQAGGSL RLSCAASGFT FD | 467 DYAIG | 749 WFRQAP GKEREG VS | 1031 CIRCSD GSTYYA DSVKG |
| LG2063C | 186 EVQLVESGG GLVQAGGSL RLSCEASGGS FS | 468 SYAMG | 750 WFRQAP GKEREF VA | 1032 AVSGWI GPRPVY ADSVKG |
| LG2063D | 187 EVQLVESGG GLVQAGGSL RLSCEASGRS FS | 469 SVAMG | 751 WFRQAP GKEREF VA | 1033 ALSRWS GARTVY ADSVKG |
| LG2063E | 188 EVQLVESGG GLVQAGGSL RLSCEASGRT FS | 470 SYAMG | 752 WFRQAP GKEREF VA | 1034 VVTRWS GGRTVY ABSVKG |
| LG2063F | 189 EVQLVESGG GLVQAGGSL RLSCEASGRT FS | 471 RYGMG | 753 WFRQAP GKEREF VA | 1035 AVSRLS GPRTVY ADSVKG |
| LG2064D | 190 EVQLVESGG GLVQAGGSL RLSCEASGRT FS | 472 PIAMG | 754 WFRQAP GKEREF VA | 1036 VVTRWS GARTVY ADSVKG |
| LG2064G | 191 EVQLVESGG GLVQAGGSL RLSCEASGRT FS | 473 SVAMG | 755 WFRQAP GKEREF VA | 1037 AVSRWS GARTVY ADSVKG |
| LG2065A | 192 EVQLVESGG GLVQAGGSL RLSCEASRRT FS | 474 SYAMVG | 756 WFRQAP GKEREF VA | 1038 AVTRWS GARTVY ADSVKG |
| LG2065E | 193 EVQLVESGG GLVQAGGSL RLSCEASGRT ER | 475 YQAMG | 757 WFRQAP GKEREF VA | 1039 VVTRWS GARTVY ADSVKG |

TABLE B-1-continued

Preferred combinations of CDR sequences, preferred combinations of framework sequences, and preferred combinations of framework and CDR sequences.

| | | | | | | | | |
|---|---|---|---|---|---|---|---|---|
| LG2066A | 194 | EVQLVESGG GLVQAGGSL RLSCEASGRT FS | 476 | SYAMVG | 758 | WFRQAP GKEREF VA | 1040 | AVTRWS GARTVY ADSVKG |
| LG2066D | 195 | EVQLVESGG GLVQPGGSL GLSCAASGNI FS | 477 | ITGMG | 759 | WYRQAP GNQREL VA | 1041 | QISHYDS TMYADS VKG |
| LG2067B | 196 | EVQLVESGG GSVQPGGSA RLSCAVLGSI GS | 478 | LNAMG | 760 | WYRQTP GKEREL VA | 1042 | RITSLGP IMYAEFV KG |
| LG2067C | 197 | EVQLVESGG GLAQPGGSL RLSCAASGFT FN | 479 | DYAMG | 761 | WFRQAP GKEREF VA | 1043 | GISWAG HNTVYA GSMKG |
| LG2067E | 198 | EVQLVESGG GLVQAGGSL RLSCAASERT VI | 480 | AYTMG | 762 | WFRRAP GKERDF VA | 1044 | AMNWN GGNTIYA DSAKG |
| LG2067G | 199 | EVQLVESGG GLVQAGGSL RLSCAASERT FI | 481 | PYPMG | 763 | WFRQAP GKEREF VG | 1045 | AISGGG FPTFYA DSVKG |
| LG2067H | 200 | EVQLVESGG GLVQPGGSL RLSCAASGFV FS | 482 | HYAMS | 764 | WVRQAP GKGLEW VS | 1046 | DITHGGL STTYRD SVKG |
| LG20711A | 201 | EVQLVESGG GLVQPGGSLT LSCAASGSVFS | 483 | VNAMG | 765 | WHRQA PGKERE LVA | 1047 | QLTVFG SLNYAD SVKG |
| LG20711B | 202 | EVQLVESGG GLVQPGGSL RLSCAASGFT FD | 484 | YYAIG | 766 | WFRQAP GKEREG VS | 1048 | CISSSDS STYYAD SVKG |
| LG20711D | 203 | EVQLVESGG GLVQAGGSL RLSCTASGRT LS | 485 | SYAMG | 767 | WFRQTP GKEREF VA | 1049 | SISWIGK FTYYAD SVKG |
| LG20711E | 204 | EVQLVESGG GLVQAGGSL RLSCTAGGDT FS | 486 | SYAMG | 768 | WFRQTP GKEREF VA | 1050 | SISWIGK FTYYAD SVKG |
| LG20711F | 205 | EVQLVESGG GLVQPGGSL RLSCAASGFV FS | 487 | HYAMS | 769 | WVRQAP GKGLEW VS | 1051 | DITNGGL STTYRD SVKG |
| LG20711G | 206 | EVQLVESGG GLVQAGGSL RLSCAAPGRT FS | 488 | TWVMG | 770 | WFRQAP GKEREF VA | 1052 | RIDWGG SSTSYA DIVKG |
| LG20711H | 207 | EVQLVESGG GLVQPGGSL RLSCAASGFV FS | 489 | HYAMS | 771 | WVRQAP GKGLEW VS | 1053 | BITHGGL TTTYRD SVKG |
| LG2071A | 208 | EVQMVESGG GLVQPGGSL RLSCVASGSI AR | 490 | LNTMG | 772 | WYRQAP GKQREL VA | 1054 | TLSIFGV SDYADS VKG |

TABLE B-1-continued

Preferred combinations of CDR sequences, preferred combinations of framework sequences, and preferred combinations of framework and CDR sequences.

| | | | | | | | | |
|---|---|---|---|---|---|---|---|---|
| LG2071B | 209 | EVQLVESGG GLVQAGGSL RLSCAASGSL FR | 491 | IFTMG | 773 | WYRQAP GKQREL VA | 1055 | DITTGGS TNYADS VKG |
| LG2071C | 210 | EVQLVESGG GLVQAGGSL RLSCAASGPT FS | 492 | ADTMG | 774 | WFRQAP GKEREF VA | 1056 | TIPWSG GIAYYSD SVKG |
| LG207D1 | 211 | EVQLVESGG GLVQAGGSL RLSCEASGRT FS | 493 | SYGMG | 775 | WFRQAP GKEREF VA | 1057 | AVSRLS GPRTVY ADSVKG |
| LG2071E | 212 | EVQLVESGG GLVQAGGSL RLSCAASGPT FS | 494 | TMG | 776 | WFRQAP GKEREF VA | 1058 | TIPWSG GIPYYSD SVKG |
| LG2071F | 213 | EVQLVESGG GLVQAGGSL RLSCAASGPT FS | 495 | ADTMG | 777 | WFRQAP GKEREF VA | 1059 | TIPWSG GIAYYSD SVKG |
| LG2074A | 214 | EVQLVESGG GLVQPGGSL RLSCAASGSI FS | 496 | INAMG | 778 | WYRQAP GKQRDL VA | 1060 | HITFGGS SYYADS VKG |
| LG2074B | 215 | EVQLVESGG GLVQPGGSL RLSCAASGSI FS | 497 | INAMG | 779 | WYRQAP GKQRDL VA | 1061 | HITFGGN SYYADS VKG |
| LG2074D | 216 | EVQLVESGG GLVQAGGSL RLSCVASGRT FN | 498 | NLAMG | 780 | WFRQAR GKEREF VA | 1062 | TISWSH PNTYYT DSVKG |
| LG2074H | 217 | EVQLVESGG GLVQAGGSL RLSCAASGSS GV | 499 | INAMA | 781 | WHRQA PGKERE LVA | 1063 | HISSGG STYYGD FVKG |
| LG2075A | 218 | EVQLVESGG GLVQAGGSL RLSCAASGSL FR | 500 | IFTMG | 782 | WYRQAP GKQREL VA | 1064 | DITTGGS TNYADS VKG |
| LG2075B | 219 | EVQLVESGG GLVQPGGSL RLSCAASGSI FS | 501 | INAMG | 783 | WYRQAP GKQREL VA | 1065 | HISSGG STYYGD SVKG |
| LG2075C | 220 | EVQLVESGG GLVQAGGSL RLSCAASGPT FS | 502 | ADTMG | 784 | WFRQAP GKEREF VA | 1066 | TIPWSG GIAYYSD SVKG |
| LG2075D | 221 | EVQLVESGG GLVQAGGSL RLSCEASGRT FS | 503 | NYAMG | 785 | WFRQAP GKEREF VA | 1067 | VVTRWS GGRTVY ADSVKG |
| LG2075E | 222 | EVQLVESGG GSVQPGGSL RLSCAASGSI VG | 504 | INAMG | 786 | WYRQAL GKQREL VA | 1068 | TIGNGG NTNYAD SAKG |
| LG2076A | 223 | EVQLVESGG GLVQPGGSL RLSCAASGSI FS | 505 | INAMG | 787 | WYRQAP GKQREL VA | 1069 | HITSGGS TNYADS VKG |

TABLE B-1-continued

Preferred combinations of CDR sequences, preferred combinations of framework sequences, and preferred combinations of framework and CDR sequences.

| | | | | | | | | |
|---|---|---|---|---|---|---|---|---|
| LG2076B | 224 | EVQLVESGG GLVQAGGSL RLSCEASGRT YS | 506 | RYGMG | 788 | WFRQAP GKEREF VA | 1070 | AVSRLS GPRTVY ADSVKG |
| LG2076C | 225 | EVQLVESGG GLVQPGGSLK LSCAASGGFFS | 507 | IDAMG | 789 | WYRQAP GKQREL VA | 1071 | AITSGGN TNYADS VKG |
| LG2076D | 226 | EVQLVESGG GLVQPGGSL RLSCAASGSI FG | 508 | LNAMG | 790 | WYRQVP GKEREL VV | 1072 | SISSGGS TTYADS VKGRG |
| LG2076E | 227 | EVQLVESGG GLVQPGGSL RLSCAASGSI VG | 509 | INAMG | 791 | WYRQAP GKQREL VA | 1073 | TIGNGG NTNYAD SAKG |
| LG2076F | 228 | EVQLVESGG GLVQAGGSLK LSCAVSARIFS | 510 | TNSVD | 792 | WYRQIP GKQRD WVA | 1074 | TITPSPY TYYADS VKG |
| LG2079A | 229 | EVQLVESGG GLVQAGGSL RLSCAASGRT FS | 511 | SSFMA | 793 | WFRQVL GSDREF VG | 1075 | GISPGG RFTYYA DSRKG |
| LG2079B | 230 | EVQLVESGG GLVQAGGSL RLSCAASGRT FS | 512 | SSFMA | 794 | WFRQVL GSDREF VG | 1076 | GISPGG RFTYYA DSRKG |
| LG2079C | 231 | EVQLVESGG GLVQAGGSL RLSCAASGRT GG | 513 | TITMA | 795 | WFRQAP GKEREF VA | 1077 | VISWGGI TTSYAD SVKG |
| LG2079D | 232 | EVQLVESGAG LVQAGGSLRL SCTASGRTFS | 514 | SYAMG | 796 | WFRQTP GKEREF VA | 1078 | SISWIGE FIYYADS VKG |
| LG2079E | 233 | EVQLVKSGG GLVQAGGSLK LSCAASGRAFS | 515 | SYTMG | 797 | WFRQAP GKEREF VA | 1079 | SISRDG GTPYYA YSVKG |
| LG2079F | 234 | EVQLVESGG GLVQPGGSL RLSCAASGFV FS | 516 | HYAMS | 798 | WVRQAP GKGLEW VS | 1080 | DITNGGL STTYRD SVKG |
| LG2079G | 235 | EVQLVESGG GLVQAGGSL RLSCAASERT VI | 517 | AYTMG | 799 | WFRRAP GKERDF VA | 1081 | AMNWN GGNTIYA DSAKG |
| LG2079H | 236 | EVQLVESGG GLVQAGGSL RLSCAASGRT FS | 518 | SSFMA | 800 | WFRQAL GSDREF LG | 1082 | GISPGS RFTYYA DSGKG |
| LG213B7 | 237 | EVQLVESGG GLVQAGGSL RLSCTVSGDT FD | 519 | NSAAG | 801 | WYRATS ETQREL VA | 1083 | RIRSSGS TNYADS VKG |
| LG213D6 | 238 | EVQLVESGG GLVQPGGSL RLSCAASGFT FG | 520 | DSDMS | 802 | WVRQAP GEGPE WVA | 1084 | GINSGG GSTVYA DSVKG |
| LG213D7 | 239 | EVQLVESGG GLVQAGGSL RLSCTVSGDT FD | 521 | NSAAG | 803 | WYRATS ETQREL VA | 1085 | RIRSSGS TNYADS VKG |

TABLE B-1-continued

Preferred combinations of CDR sequences, preferred combinations of framework sequences, and preferred combinations of framework and CDR sequences.

| | | | | | | | | |
|---|---|---|---|---|---|---|---|---|
| LG213E6 | 240 | EVQLVESGG GLVQAGASLR LSCAASGSTLS | 522 | RYGVG | 804 | WFRQAP GKEREL VA | 1086 | SVDWSG SRTYYA DSVKG |
| LG213H7 | 241 | EVQLVESGG GLVQAGGSL RLSCAASGRT LS | 523 | SYRMG | 805 | WFRQAP GKEREFIS | 1087 | TISWNG RSTYYA DSVKG |
| LG214A8 | 242 | EVQLVKSGG GSVQAGGSL RLSCAASGGT FN | 524 | PYVMA | 806 | WFRQAP GNEREF VA | 1088 | RIRWSG GDAYYD DSVKG |
| LG214C10 | 243 | EVQLVESGG GLVQPGGSL RLSCAASGFI FG | 525 | SYDMS | 807 | WVRQAP GKGPE WVS | 1089 | GINSGG GSTGYA DSVKG |
| LG214D10 | 244 | EVQLVESGG GLVQAGGSL RLSCAASGG RTF | 526 | SRVVAG | 808 | WFRQAP GKEREF VA | 1090 | AISWDG VQTYYT DSVEG |
| LG214E8 | 245 | EVQLVESGG GSVQAGGSL RLSCAASGGT FN | 527 | PYVMA | 809 | WFRQAP GNEREF VA | 1091 | RIRWSG GDAYYD DSVKG |
| LG214F8 | 246 | EVQLVESGG DLVQAGGSLR LSCVASGSTYS | 528 | INAMG | 810 | WYRQAP GKLREL VA | 1092 | AFRTGG STDYAD SVKG |
| LG214H10 | 247 | EVQLVESGG GSVQAGGSL RLSCAASGGT FN | 529 | PYVMA | 811 | WFRQAP GNEREF VA | 1093 | RIRWSG GDAYYD DSVKG |
| RSVPMP5C1 | 248 | EVQLVESGG GLAQAGGSL RLSCAASGRT LT | 530 | SYIMG | 812 | WFRQAP GKERMF VA | 1094 | AISGTGT IKYYGDL VKG |
| RSVPMP8A1 | 249 | EVQLVESGG GLVQPGGSL RVSCAASGFT FN | 531 | DYIMG | 813 | WFRQAP GKERMF IA | 1095 | AISGTGT IKYYGDL VRG |
| RSVPMP8G1 | 250 | EVQLVESGG GLVQPGGSL RVSCAASGFT FN | 532 | SYIMG | 814 | WFRQAP GKERMF IA | 1096 | AISGTGT IKYYGDL VGG |
| RSVPMP25B3 | 251 | EVQLVESGG GLVQPGGSL RLSCAASGFT FN | 533 | SYIMG | 815 | WFRQAP GKERMF IA | 1097 | AISGTGT IKYYGDL VGG |
| RSVPMP8C8 | 252 | EVQLVESGG GLVQAGGSL RLSCVASGGT FS | 534 | TYGMG | 816 | WFRQAA GKEREF AV | 1098 | AISRSGA NIYYGTS TQG |
| RSVPMP5A6 | 253 | EVQLVESGG GLVQPGGSL RLSCTAYGFIFD | 535 | RSRMF | 817 | WARQAP GKGFEW LS | 1099 | SILTAGD TWYSDS VKG |
| RSVPMP8E11 | 254 | EVQLVESGG GLVQPGGSL RLSCTAYGFIFD | 536 | RSRMF | 818 | WARQAP GKGFEW LS | 1100 | SILTAGD TWYSDS VKG |
| RSVPMP8F11 | 255 | EVQLVESGG GLVQPGGSL RLSCTAYGFIFD | 537 | RSRMF | 819 | WARQAP GKGFEW LS | 1101 | SILTAGD TWYSDS VKG |

TABLE B-1-continued

Preferred combinations of CDR sequences, preferred combinations of framework sequences, and preferred combinations of framework and CDR sequences.

| | | | | | | | | |
|---|---|---|---|---|---|---|---|---|
| RSVPMP13F11 | 256 | EVQLVESGG DLVQPGGSLR LSCTAYGFIFD | 538 | QARMF | 820 | WARQAP GKGFEW LS | 1102 | SILTAGD TWYSDS VKG |
| RSVPMP15B8 | 257 | EVQLVESGG GLVQPGGSL RLSCTAYGFIFD | 539 | QSRMF | 821 | WARQAP GKGFEW LS | 1103 | SILTAGD TWYSDS VKG |
| RSVPMP15G11 | 258 | EVQLVESGG GLVQPGGSL RLSCTAYGFIFD | 540 | QSRMF | 822 | WARQAP GKGFEW LS | 1104 | SILTAGD TWHSDS VKG |
| RSVPMP17C10 | 259 | EVQMVESGG DLVQPGGSLR LSCTAYGFIFD | 541 | QARMF | 823 | WARQAP GKGFEW LS | 1105 | SILTAGD TWYSDS VKG |
| RSVPMP21E7 | 260 | EVQLVESGG DLVQPGGSLR LSCTAYGFIFD | 542 | QARMF | 824 | WARQAP GKGFEW LS | 1106 | SILTAGD TWYSDS VKG |
| RSVPMP21F8 | 261 | EVQLVESGG GLVQPGGSL RLSCTAYGFV FD | 543 | QSRMF | 825 | WARQAP GKGFEW LS | 1107 | SILTAGD TWYSDS VKG |
| RSVPMP5A2 | 262 | EVQLVESGG GLVQPGGSL RLSCEASGFT WD | 544 | YYVIG | 826 | WFRQAP GKEREG LS | 1108 | CISSDGS TTYADS VKG |
| RSVPMP5B2 | 263 | EVQLVESGG GLVQPGGSL RLSCAASGLT LD | 545 | YYALG | 827 | WFRQAP GKEREG VS | 1109 | CISSVDH STTYAD SVKG |
| RSVPMP5C3 | 264 | EVQPVESGG GLVQPGGSL RLSCEASGFT WD | 546 | YYVIG | 828 | WFRQAP GKEREG LS | 1110 | CISSSDG STTYAD SVKG |
| RSVPMP5D2 | 265 | EVQLVESGG GLVQPGGSL RLSCEASGFT WD | 547 | YYVIG | 829 | WFRQAP GKEREG LS | 1111 | CISSSDG STTYAD SVKG |
| RSVPMP5E2 | 266 | EVQLVESGG GLVQPGGSL RLSCAASGLT LD | 548 | YYAIG | 830 | WFRQAP GKEREG VS | 1112 | CISSSDH STTYAD SVKG |
| RSVPMP5F3 | 267 | EVQLVESGG GLVQPGGSL RLSCAASGLT LD | 549 | YYALG | 831 | WFRQAP GKEREG VS | 1113 | CISSSDH STTYTD SVKG |
| RSVPMP5G3 | 268 | EVQLVESGG GLVQPGGSL RLSCEASGFT WD | 550 | YYVIG | 832 | WFRQAP GKEREG LS | 1114 | CISSDGS TTYADS VKG |
| RSVPMP5H2 | 269 | EVQLVESGG GLVQPGGSL RLSCAASGLT LD | 551 | YYAIG | 833 | WFRQAP GKEREG VS | 1115 | CISSVDH STTYAD SVKG |
| RSVPMP5H3 | 270 | EVQLVESGG GLVQPGGSL RLSCAASGFT SD | 552 | YYAIG | 834 | WFRQAP GKEREG VS | 1116 | CISSSDG STTYADL VKG |
| RSVPMP8C1 | 271 | EVQLVESGG GLVQPGGSL RLSCAASGFT WD | 553 | YYVIG | 835 | WFRQAP GKEREG VS | 1117 | CISSDGT TTYPDS VKG |

TABLE B-1-continued

Preferred combinations of CDR sequences, preferred combinations of framework sequences, and preferred combinations of framework and CDR sequences.

| | | | | | | | | |
|---|---|---|---|---|---|---|---|---|
| RSVPMP8F2 | 272 | EVQLVESGG GLVQPGGSL RLSCAASGFT WD | 554 | YYAIG | 836 | WFRQAP GKEREG VS | 1118 | CISSSDG STTYAD SVKG |
| RSVPMP8G4 | 273 | EVQLEESGG GLVQPGGSL RLSCEASGFT WD | 555 | YYVIG | 837 | WFRQAP GKEREG LS | 1119 | CISSDGL TTYADS VKG |
| RSVPMP13A1 | 274 | EVQLVESGG GLVQPGGSL RLSCAASGLT LD | 556 | YYALG | 838 | WFRQAP GKEREG VS | 1120 | CISSADH STTYAD SVKG |
| RSVPMP13A4 | 275 | EVQLVESGG GLVQPGGSL RLSCAASGLT LD | 557 | YYALG | 839 | WFRQAP GKEREG VS | 1121 | CISSADH STTYAD SVKG |
| RSVPMP13B1 | 276 | EVQLVESGG GLVQPGGSL RLSCAASGFT WD | 558 | YYVIG | 840 | WFRQAP GKEREG VS | 1122 | CISSSDG STTYAD FVKG |
| RSVPMP13B2 | 277 | EVQLVESGG GLVQPGGSV RLSCAASGFT WD | 559 | YYVIG | 841 | WFRQAP GKEREG LS | 1123 | CISSDGS TTYADS VKG |
| RSVPMP13C1 | 278 | EVQLVESGG GLVQPGGSL RLSCEASGFT WD | 560 | YYVIG | 842 | WFRQAP GKEREG LS | 1124 | CISSDGS TTYADS VKG |
| RSVPMP13C3 | 279 | EVQLVESGG GLVQPGGSL RLSCAASGLT LD | 561 | YYALG | 843 | WFRQAP GKEREG VS | 1125 | CISSVDH STTYAD SVKG |
| RSVPMP13D6 | 280 | EVQLVESGG GLVQPGGSL RLSCAASGLT LD | 562 | YYALG | 844 | WFRQAP GKEREG VS | 1126 | CISSSDH STTYAD SVKG |
| RSVPMP13E2 | 281 | EVQLVESGG GLVQPGGSL RLSCAASGLT LD | 563 | YYAIG | 845 | WFRQAP GKEREG VS | 1127 | CISSTDH STTYAD SVKG |
| RSVPMP13E3 | 282 | EVQLVESGG GLVQPGGSL RLSCAASGLT LD | 564 | YYALG | 846 | WFRQAP GKEREG VS | 1128 | CISSSDH TTTYAD SVKG |
| RSVPMP15A5 | 283 | EVQLVESGG GLVQPGGSL RLSCAASGFT WD | 565 | YYAIG | 847 | WFRQAP GKEREG VS | 1129 | CISSSDG STTYAD SVKG |
| RSVPMP15A6 | 284 | EVQLVESGG GLVQPGGSL RLSCAASGLT LD | 566 | YYALG | 848 | WFRQAP GKEREG VA | 1130 | CIDSSDH STTYAD SVKG |
| RSVPMP15B2 | 285 | EVQLVESGG GLVQPGGSL RLSCEASGFT WD | 567 | YYVIG | 849 | WFRQAP GKEREG LS | 1131 | CISSDGS TTYADS VKG |
| RSVPMP15B3 | 286 | EVQLVESGG GLVQPGGSL RLSCAASGLT LD | 568 | YYALG | 850 | WFRQAP GKEREG VS | 1132 | CISSSDH STTYTD SVKG |

TABLE B-1-continued

Preferred combinations of CDR sequences, preferred combinations of framework sequences, and preferred combinations of framework and CDR sequences.

| | | | | | | | | |
|---|---|---|---|---|---|---|---|---|
| RSVPMP15E5 | 287 | EVQLVESGG GLVQPGGSL RLSCAASGFT WD | 569 | YYVIG | 851 | WFRQAP GKEREG VS | 1133 | CISSSDG STTYAD FVKG |
| RSVPMP17C2 | 288 | EVQLVESGG GLVQPGGSL RLSCAASGFT WD | 570 | YYVIG | 852 | WFRQAP GKEREG VS | 1134 | CISSSDG STTYAD FVKG |
| RSVPMP17D4 | 289 | EVQLVESGG GLVQPGGSL RLSCAASGLT LD | 571 | YYALG | 853 | WFRQAP GKEREG VS | 1135 | CISSVDH STTYAD SVKG |
| RSVPMP17G4 | 290 | EVQLVESGG GLVQPGGSL RLSCAASGLT LD | 572 | YYAIG | 854 | WFRQAP GKEREG VS | 1136 | CISSVDH STTYAD PVKG |
| RSVPMP19B2 | 291 | EVQLVESGG GLVQPGGSL RLSCAASGLT LD | 573 | YYAIG | 855 | WFRQAP GKEREG VS | 1137 | CISSSDH STTYAD SVKG |
| RSVPMP25A4 | 292 | EVQLVESGG GLVQPGGSL RLSCAASGLT LD | 574 | YYALG | 856 | WFRQAP GKEREG VS | 1138 | CISSVDH STTYAD SVKG |
| RSVPMP25A9 | 293 | EVQLVESGG GLVQPGGSL RLSCEASGFT WD | 575 | YYVIG | 857 | WFRQAP GKEREG LS | 1139 | CISSDGL TTYADS VKG |
| RSVPMP25B5 | 294 | EVQLVESGG GLVQPGGSL RLSCAASGLT LD | 576 | YYALG | 858 | WFRQAP GKEREG VS | 1140 | CISSSDH STTYAD SVKG |
| RSVPMP25G2 | 295 | EVQLVESGG GLVQPGGSL RLSCAASGLT LD | 577 | YYALG | 859 | WFRQAP GKEREG VS | 1141 | CISSVDH STTYAD SVKGQ |
| RSVPMP25H5 | 296 | EVQLVESGG GLVQPGGSL RLSCVASGLT LD | 578 | YYALG | 860 | WFRQAP GKEREG VS | 1142 | CISSSDH STTYAD SVKG |
| RSVPMP25E11 | 297 | EVQLVESGG GLVQPGGSL RLSCAASGFT WD | 579 | YYAIG | 861 | WFRQAP GKEREG VS | 1143 | CISSSDG STTYAD SVKG |
| RSVPMP8G3 | 298 | EVQLVESGG GLVQPGGSL RLSCAASGLT LD | 580 | YYALG | 862 | WFRQAP GKEREG VS | 1144 | CISSSDH TTTYAD SVKG |
| RSVPMP13B5 | 299 | EVQLVESGG GLVQPGGSL RLSCAASGLT LD | 581 | YYALG | 863 | WFRQAP GKGREG VS | 1145 | CISSSDH TTTYAD SVKG |
| RSVPMP15F2 | 300 | EVQLVESGG GLVQPGGSL RLSCAASGLT LD | 582 | YYALG | 864 | WFRQAP GKEREG VS | 1146 | CISSSDH TTTYAD SVKG |
| RSVPMP19E2 | 301 | EVQLVESGG GLVQPGGSL RLSCAASGLT LD | 583 | YYALG | 865 | WFRQAP GKEREG VS | 1147 | CISSSDH TTTYTDS VKG |

TABLE B-1-continued

Preferred combinations of CDR sequences, preferred combinations of framework sequences, and preferred combinations of framework and CDR sequences.

| | | | | | | | | |
|---|---|---|---|---|---|---|---|---|
| RSVPMP25D1 | 302 | EVQLVESGG GLVQPGGSL RLSCAASGLT LD | 584 | YYALG | 866 | WFRQAP GKEREG VS | 1148 | CISSSDH TTTYAD SVKG |
| RSVPMP5A1 | 303 | EVQLMESGG GLVQPGGSL RLSCATSGFT LD | 585 | YYVIG | 867 | WFRQAP GKEREG VS | 1149 | CMSSSG DITTYAP SVKG |
| RSVPMP5G2 | 304 | EVQLVESGG GLVQPGGSL RLSCATSGFT LD | 586 | YYVIG | 868 | WFRQAP GKEREG VS | 1150 | CMSSSG DSTTYA DSVKG |
| RSVPMP5H1 | 305 | EVQLVESRG GLVQPGGSL RLSCATSGFT LD | 587 | YYVIG | 869 | WFRQAP GKEREG VS | 1151 | CMSSSG DSTTYA DSVKG |
| RSVPMP6B1 | 306 | EVQLVESGG GLVRPGGSLR LSCATSGFTED | 588 | YYVIG | 870 | WFRQAP GKEREG VS | 1152 | CMSSSG DSTTYA DSVKG |
| RSVPMP8H2 | 307 | EVQLVESGG GLVQPGGSLT LSCATSGLTLD | 589 | YYVIG | 871 | WFRQAP GKEREG LS | 1153 | CMSSSG DSTTYA DSVKG |
| RSVPMP8H3 | 308 | EVQLVESGG GLVQPGGSL RLSCATSGFT ED | 590 | YYVIG | 872 | WFRQAP GKEREG VS | 1154 | CMSSSG DSTTYA DSVKG |
| RSVPMP13A3 | 309 | EVQLVESGG GLVQPGGSL RLSCATSGFT LD | 591 | YYVIG | 873 | WFRQAP GKEREG VS | 1155 | CMSSSG DSTTYA DSVKG |
| RSVPMP13C5 | 310 | EVQLVESGG GLVQPGGSL RLSCATSGLT LD | 592 | YYVIG | 874 | WFRQVP GKEREG VS | 1156 | CMSSSG DSTTYA DSVKG |
| RSVPMP13H1 | 311 | EVQLVESGG GLVQPGGSL RLSCATSGFT MD | 593 | YYVIG | 875 | WFRQAP GKEREG VS | 1157 | CMSSSG DSTTYA PSVKG |
| RSVPMP13H2 | 312 | EVQLVESGG GLVQPGGSLT LSCATSGLTLD | 594 | YYVIG | 876 | WFRQAP GKEREG VS | 1158 | CMSSSG DSTTYA DSVKG |
| RSVPMP15E6 | 313 | EVQLVESGG GLVQPGGSL RLSCATSGFT ED | 595 | YYVIG | 877 | WFRQAP GKEREG VS | 1159 | CMSSSG DSTTYA DSVQG |
| RSVPMP17A3 | 314 | EVQLVESGG GLVQPGGSL RLSCATSGFT LD | 596 | YYVIG | 878 | WFRQAP GKEREG VS | 1160 | CMSSSG DITTYAP SVKG |
| RSVPMP25G8 | 315 | EVQLVESGG GLVQPGGSL RLSCATSGFT LD | 597 | YYVIG | 879 | WFRQAP GKEREG VS | 1161 | CMSSSG DITTYAP SVKG |
| RSVPMP6D1 | 316 | EVQLVESGG GLVQAGGSL RLSCAASGFT FD | 598 | DYAIG | 880 | WFRQAP GKEREA VS | 1162 | CISSSDG TTYYAD SVKG |
| RSVPMP8D5 | 317 | EVQLVESGG GLVQAGGSL RLSCAASGFT FD | 599 | DYAIG | 881 | WFRQAP GKEREA VS | 1163 | CISSSDG STYYTD SVKG |

TABLE B-1-continued

Preferred combinations of CDR sequences, preferred combinations of framework sequences, and preferred combinations of framework and CDR sequences.

| | | | | | | | | |
|---|---|---|---|---|---|---|---|---|
| RSVPMP13B4 | 318 | EVQLVESGG GLVQAGGSL RLSCAASGFT FD | 600 | DYAIG | 882 | WFRQAP GKEREA VS | 1164 | CISSSDG STYYAD SVKG |
| RSVPMP13B6 | 319 | EVQLVESGG GLVQAGGSL RLSCAASGFT FD | 601 | DYAIG | 883 | WFRQAP GKEREA VS | 1165 | CISSSDS STYYTD SVKG |
| RSVPMP13E6 | 320 | EVQLVESGG GLVQAGGSL RLSCAASGFT FD | 602 | DYAIG | 884 | WFRQAP GKEREA VS | 1166 | CISSSDG VTYYSD SVKG |
| RSVPMP13F4 | 321 | EVQLVESGG GLVQAGGSL RLSCAASGFT FD | 603 | DYAIG | 885 | WFRQAP GKEREA VS | 1167 | CISSSDG STYYTD SVKG |
| RSVPMP15H3 | 322 | EVQLVESGG GLVQAGGSL RLSCAASGLT FD | 604 | DYAIG | 886 | WFRQAP GKEREA VS | 1168 | CISSSDG STYYAD SVKG |
| RSVPMP17E5 | 323 | EVQLVESGG GLVQAGGSL RLSCAASGFT FD | 605 | DYAIG | 887 | WFRQAP GKEREA VS | 1169 | CISSSDG TTYYAD SVKG |
| RSVPMP19D3 | 324 | EVQLVESGG GLVQAGGSL RLSCAASGFT FD | 606 | DYAIG | 888 | WFRQAP GKEREG VS | 1170 | CIDSSD GSTYYA DSVKG |
| RSVPMP19F3 | 325 | EVQLVESGG GLVQAGGSL RLSCAASGFT FD | 607 | DYAIG | 889 | WFRQAP GKEREA VS | 1171 | CISSSDG TTYYAD SVKG |
| RSVPMP25C4 | 326 | EVQLVESGG GLVQAGGSL RLSCAASGFT FD | 608 | DYAIG | 890 | WFRQAP GKEREA VS | 1172 | CISSSDG TYYADS VKG |
| RSVPMP25E3 | 327 | EVQLVESGG GKVQPGGSL RLSCAASGFT FD | 609 | DYAIG | 891 | WFRQAP GKEREG VS | 1173 | CIDSSD GSTYYA DSVKG |
| RSVPMP5G4 | 328 | EVQLVESGG GLVQAGGSL RLSCAASGRT FS | 610 | SYAMG | 892 | WFRQAP GKEREF VG | 1174 | AISGSGS NIYYANS MPG |
| RSVPMP6G5 | 329 | EVQLVQSGG GLVQAGGSL RLSCAASGRT FS | 611 | SYAMG | 893 | WFRQAP GKEREF VG | 1175 | AISGSGS NIYYANA MPG |
| RSVPMP8E6 | 330 | EVQLVESGG GLVQAGGSL RLSCAASGRT FS | 612 | SYAMG | 894 | WFRQAP GKEREF VG | 1176 | AISGSGS NIYYADS MPG |
| RSVPMP13A10 | 331 | EVQLVESGG GLVQAGGSL RLSCAASGRT FS | 613 | SYAMG | 895 | WFRQAP GKEREF VG | 1177 | AISESGS NIYYANA MPG |
| RSVPMP21H10 | 332 | EVQLVESGG GLVQAGGSL RLSCAASGRT FS | 614 | SYAMG | 896 | WFRQAP GKEREF VG | 1178 | AISGSGS NIYYANS MPG |

TABLE B-1-continued

Preferred combinations of CDR sequences, preferred combinations of framework sequences, and preferred combinations of framework and CDR sequences.

| | | | | | | | | |
|---|---|---|---|---|---|---|---|---|
| RSVPMP5A8 | 333 | EVQLVESGGGLVQAGGSLRLSCADHGRTLA | 615 | YYTAG | 897 | WFRQAPGKEREFVA | 1179 | SISRSSGSTRYADSVRG |
| RSVPMP5A10 | 334 | EVQLVESGGGLVQAGDSLRLSCTASERTFR | 616 | NDAGG | 898 | WFRQAPGKEREFVA | 1180 | AITSGGSTDYANSVKG |
| RSVPMP14A6 | 335 | EVQLVESGGGLVQAGDSLRLSCTASERTFG | 617 | NDAGG | 899 | WFRQAPGKERDFVA | 1181 | AITSGGSTDYANSVKG |
| RSVPMP16A6 | 336 | EVQLVESGGGLVQAGDSLRLSCTASERTFG | 618 | NDAGG | 900 | WFRQAPGKERDFVA | 1182 | AITSGGSTDYANSVKG |
| RSVPMP22D6 | 337 | EVQLVESGGGLVHPGGSLRLSCAASERTFG | 619 | NDAGG | 901 | WFRQAPGKERDFVA | 1183 | AITSGGSTDYANSVKG |
| RSVPMP8E2 | 338 | EVQLVESGGGLVQPGGSLRLSCAASGSIWS | 620 | ITSMG | 902 | WYRQAAGKQRELVA | 1184 | KIISGGSTNYADSVKG |
| RSVPMP8C6 | 339 | EVQLVESGGGLVQPGGSLSVSCAASGTIFA | 621 | INAMG | 903 | WYRQVPGKERELVA | 1185 | VMRNPGGTNYADSVKG |
| RSVPMP5C6 | 340 | EVQLVESGGGLVQAGASLRLSCAASGLAFS | 622 | RYAMG | 904 | WFRQAPGKERESVA | 1186 | AISSSGDNIYYADSVKGQ |
| RSVPMP6D4 | 341 | EVQLVESGGGLVHAGASLRLSCVASGLAFS | 623 | RYAMG | 905 | WFRQAPGKERESVA | 1187 | AISSSGDNIYYSRSVKGIL |
| RSVPMP8B10 | 342 | EVQLVESGGGLVQAGASLRLSCAASGLAFS | 624 | RYAMG | 906 | WFRQAPGKERESVA | 1188 | AISSSGDNIYYADSVKGQ |
| RSVPMP8E10 | 343 | EVQLVESGGGLVQAGASLRLSCAASGLAFS | 625 | RYAMG | 907 | WFRQAPGKERESVA | 1189 | AISSSGDNIYYPDSVKGQ |
| RSVPMP15A7 | 344 | EVQLVESGGGLVHAGASLRLSCVASGLAFS | 626 | RYAMG | 908 | WFRQAPGKERESVA | 1190 | AISSSGDNIYYSRSVKGIL |
| RSVPMP15E10 | 345 | EVQLVESGGGLVQAGASLRLSCAASGLAFS | 627 | RYAMG | 909 | WFRQAPGKERESVA | 1191 | AISSSGDNIYYADSVKGQ |
| RSVPMP13C7 | 346 | EVQLVESGGGLVQAGGSLRLSCAASVGTFS | 628 | NYDIG | 910 | WFRQAPGKGREFVA | 1192 | RISSAGSNLYYGSSMPG |
| RSVPMP15A9 | 347 | EVQLVESGGGLVQPGGSLRLSCAASAGTFS | 629 | NYDIG | 911 | WFRQAPGKGREFVA | 1193 | RISSGGSNIYYGNSMPG |
| RSVPMP15F11 | 348 | EVQLVESGGGLVQPGGSLRLSCAASAGTLS | 630 | NYDIG | 912 | WFRQAPGKGREFVA | 1194 | RISSAGSNLYYGTSMPG |
| RSVPMP15A1 | 349 | EVQLVESGGGLVQPGGSLRLSCAASGFTLD | 631 | YYAIG | 913 | WFRQAPGKEREGVS | 1195 | CISSWDGSTYYADSVKG |

TABLE B-1-continued

Preferred combinations of CDR sequences, preferred combinations of framework sequences, and preferred combinations of framework and CDR sequences.

| | | | | | | | | |
|---|---|---|---|---|---|---|---|---|
| RSVPMP6H2 | 350 | EVQLVESGG GLVQPGESLR LSCAASGFTLA | 632 | YYAIG | 914 | WFRQAP GKEREG VS | 1196 | CISSWD GSTYYA DSVKG |
| RSVPMP17A9 | 351 | EVQLVESGG GLVQAGGSL RLSCAASGRT FS | 633 | RYIMG | 915 | WFRQAP GKEREF VG | 1197 | AISRSGD ITSFADF VKG |
| RSVPMP7G1 | 352 | EVQLVESGG GLVQAGDSLR LSCAASGRSFS | 634 | SRAMG | 916 | WFRQAP GKEREF VA | 1198 | AINWIGN IPYYANS VKG |
| RSVPMP5A9 | 353 | EVQLVESGG GLVQAGGSL RLSCGSSGRT FS | 635 | RYAMG | 917 | WFRQAP GKEREF VA | 1199 | AISWSG GSTYYA DSVKG |
| RSVPMP7B2 | 354 | EVQLVESGG GLVQAGDSLR LSCAASGRTFS | 636 | SYAMG | 918 | WFRQAP GKEREF VA | 1200 | AISWSD GSTYYA DSVKG |
| RSVPMP22A4 | 355 | EVQLVESGG GLVQAGGSL RLSCGSSGRT FS | 637 | RYAMG | 919 | WFRQAP GKEREF VA | 1201 | AISWSG GSTYYA DSVKG |
| RSVPMP22E10 | 356 | EVQLVESRG GLVQAGGSL RLSCGSSGRT FS | 638 | RYAMG | 920 | WFRQAP GKEREF VA | 1202 | AISWSG GSTYYA DSVKG |
| RSVPMP22H4 | 357 | EVQLVESGG GLVQAGGSL RLSCGSSGRT FS | 639 | RYAMG | 921 | WFRQAP GKEHEF VA | 1203 | AISWSG GSTYYA DSVKG |
| RSVPMP15C5 | 358 | EVQLVESGG GWVQAGGSL RLSCAASGRA FS | 640 | SYAMG | 922 | WIRQAP GKEREF VA | 1204 | GIDQSG ESTAYG TSASG |
| RSVNC39 | 359 | EVQLVESGG GWVQAGGSL RLSCAASGRA FS | 641 | SYAMG | 923 | WIRQAP GKEREF VA | 1205 | GIDQSG ESTAYG ASASG |
| RSVPMP7B9 | 360 | EVQLVESGG GLVQAGGSL RLSCAASGRT FS | 642 | SYTMG | 924 | WFRQAP GKEREF VA | 1206 | AIHWSG SNIYYGN SMKG |
| RSVPMP15E11 | 361 | EVQLVESGG GLVQAGGSL RLSCVASGLT FE | 643 | HYYMG | 925 | WYRQAP KKEREF VA | 1207 | DISRAGA SRYADS VKG |
| RSVPMP7E7 | 362 | EVQLVESGG GLVQPGGSL RLSCSASGFT FS | 644 | VYAMN | 926 | WVRQAP GKGLEW VS | 1208 | GISFSG GATMYA DSVKG |
| RSVPMP14H3 | 363 | EVQLVESGG GLVQAGGSL RLSCVASGRS FS | 645 | NYPMG | 927 | WFRQAP GKEREF VG | 1209 | AISGSGS NLYYPG SWKG |
| RSVPMP24D6 | 364 | EVQLVESGG GLVQAGGSL RLSCAASGLT LD | 646 | DYAIG | 928 | WFRQG PGKARE GVS | 1210 | CISSSDG STYYAD SVKG |
| RSVPMP23E5 | 365 | EVQLMESGG GLVQAGGSL RLSCAASGGT FS | 647 | SYAMG | 929 | WFRQAP GEERDF VA | 1211 | AIGWSG NSPYYA QFVKG |

TABLE B-1-continued

Preferred combinations of CDR sequences, preferred combinations of framework sequences, and preferred combinations of framework and CDR sequences.

| | | | | | | | | |
|---|---|---|---|---|---|---|---|---|
| RSVPMP8A6 | 366 | EVQLVESGG GLVQAGGSL RLSCAASGFT FD | 648 | DYAIG | 930 | WFRQAP GKEREG VS | 1212 | CISNSD GSTYYA DSVKG |
| RSVPMP14E2 | 367 | EVQLVESGG GLVQPGGSL RLSCAASGFT FG | 649 | NYAMY | 931 | WVRQAP GKGLEW VS | 1213 | AINSGG GSTGYT DSVKG |
| RSVPMP25F3 | 368 | EVQLVESGG GLVQAGGSL RLSCAASGFA VD | 650 | DYAIG | 932 | WFRQAP GKEREG VS | 1214 | SISSSDG SPYYAD SVKG |
| RSVPMP19A6 | 369 | EVQLVESGG GLVQPGGSL RLSCAASGSD FG | 651 | ISVMG | 933 | WYRQAP EKRREL VA | 1215 | TITTFGIT NYADSV KG |
| RSVPMP23G1 | 370 | EVQLVESGG GLVQAGGSL RLSCAASGRT VS | 652 | SSTMG | 934 | WFRRAP GKEREF VA | 1216 | AISWNG GTHYAD YFVKG |
| RSVPMP15H8 | 371 | EVQLVESGG GLVQAGGSL RLSCAASGRS FS | 653 | NYVLG | 935 | WFRQAP GKEREF VA | 1217 | AISFRGD SAIGAPS VEG |
| RSVNC41 | 372 | EVQLVESGG GLVQAGGSLS ISCAASGGSLS | 654 | NYVLG | 936 | WFRQAP GKEREF VA | 1218 | AINWRG DITIGPP NVEG |
| RSVPMP6A8 | 373 | EVQLAESGG GLVQPGGSL RLSCAASGFT FE | 655 | YYAMG | 937 | WFRQAP GKEREG VS | 1219 | CISSSDG STYYAD SVKG |
| RSVPMP25H9 | 374 | EVQLVESGG GLVQAGGSL RLSCTASARR FS | 656 | TSTMG | 938 | WFRQAP GNEREF VA | 1220 | CISWSG DITFYAD SVKG |
| RSVPMP8B11 | 375 | EVQLVESGG GLVQAGASLR LSCAASGRMFS | 657 | SYGMG | 939 | WFRQAP GKEREF VA | 1221 | AITWSG GYTYYL DSVKG |
| RSVPMP17E1 | 376 | EVQLVESGG GLVQPGGSL RLSCVASGLT FS | 658 | RYDMG | 940 | WFRQAP GEERKF VA | 1222 | GINWSG GRTYYA DSVKG |
| RSVPMP21A4 | 377 | EVQLVESGG GLVQAGGSL RLSCAASGLT FS | 659 | RYDMG | 941 | WFRQAP GEERQF VA | 1223 | GINWSG GRTYYA DSVKG |
| RSVPMP25A11 | 378 | EVQLVESGG GLVQAGGSL RLSCAASGLT FS | 660 | RYDMG | 942 | WFRQAP GEERKF VA | 1224 | GINWSG GRTYYA DSVKG |
| RSVPMP25C8 | 379 | EVQLVESGG GLVQPGGSL RLSCAASGLT FS | 661 | RYDMG | 943 | WFRQAP GKEREF VA | 1225 | GINWSG GRTYYA DSVKG |
| RSVNC23 | 380 | EVQLVESGG GLVQPGGSL RLSCAASGRT FS | 662 | SIAMG | 944 | WFRQAP GKEREF VA | 1226 | AISWSR GRTFYA DSVKG |
| RSVPMP20A11 | 381 | EVQLVESGG GLVQAGGSLK LSCAASGRAFS | 663 | SYTMG | 945 | WFRQAP GKEREF VA | 1227 | CVSRDG GTTYYA YSVKG |

TABLE B-1-continued

Preferred combinations of CDR sequences, preferred combinations of framework sequences, and preferred combinations of framework and CDR sequences.

| | | | | | | | | |
|---|---|---|---|---|---|---|---|---|
| RSVPMP20A9 | 382 | EVQLVESGGGLVQAGGSLRLSCAASGRTFS | 664 | SSFMA | 946 | WFRQVLGSDREFVG | 1228 | GISPGGRFTYYADSRKG |
| RSVPMP1F7 | 383 | EVQLVESGGGLVQPGGSLRLSCAASGFTFR | 665 | NYAIG | 947 | WFRQVPGKEREGVS | 1229 | CINSGGGRIDYADSVKG |
| RSVPMP20D6 | 384 | EVQLVESGGGLVQAGGSLRLSCAASGFTFD | 666 | DYAIG | 948 | WFRQAPGKEREGVS | 1230 | CIRCNDGSTYYADSVKG |
| RSVPMP1F1 | 385 | EVQLVESGGGLVQAGGSLRLSCAASGPTFS | 667 | SYTMG | 949 | WFRQAPGKEREFVA | 1231 | TIPWSGGIPYYSDSVKG |
| RSVPMP3D3 | 386 | EVQLVESGGGLVQAGGSLRLSCVASGRTFN | 668 | NLAMG | 950 | WFRQARGKEREFVA | 1232 | TISWSHPNTYYTDSVKG |
| RSVPMP3E6 | 387 | EVQLVESGGGLVQPGGSLRLSCEASGFTFS | 669 | SYWMY | 951 | WVRQVPGKGLEWVS | 1233 | AISTGGGDTHYQDSVKG |
| RSVPMP1C8 | 388 | EVQLVESGGGLVQAGDSLRLSCAASGLTFS | 670 | TYVMA | 952 | WFRQAPGKERECVA | 1234 | AINWSGENIYYADSVKG |
| RSVPMP1A2 | 389 | EVQLVESGGGLVQAGGSLRLSCAASERTFS | 671 | YYAMG | 953 | WFRQAPGKEREFVA | 1235 | TISRSGEWIYYKDAMKG |
| RSVPMP1C5 | 390 | EVQLVESGGGLVQPGGSLRLSCAASGFTLD | 672 | YYAIG | 954 | WFRQAPGKEREGVS | 1236 | CFPSRYSSDGSTYYADSVKG |
| RSVPMP20G5 | 391 | EVQLVESGGGLVQPGGSLKLSCAGSGSIFR | 673 | FYDTAG | 955 | WYRQAPGKQRELVA | 1237 | LITDISGGYIKYADSVKG |
| RSVPMP4D8 | 392 | EVQLVESGGGLVQAGGSPRLSCAASGGTFS | 674 | SYGMG | 956 | WFRQAPGKEREFVA | 1238 | AISWSDSSTYYADSVKG |
| RSVPMP20B6 | 393 | EVQLVESGGGLVQAGGSLRLSCASSGSIYS | 675 | INFMN | 957 | WYRQAPGKQRELVA | 1239 | SITSGGYTNYADSVKG |
| RSVPMP1D11 | 394 | EVQLVESGGGLVQPGGSLRLSCAASGNIFS | 676 | IATMA | 958 | WYRQAPGKQRELVA | 1240 | SISSSGYRIYADSVKG |
| RSVPMP20A8 | 395 | EVQLVESGGGLVQAGDSLRLSCAASGLTFS | 677 | GYEMG | 959 | WFRQAPGRERAFVA | 1241 | AISQSGGTTSYAVSVKG |
| RSVPMP20E7 | 396 | EVQLVESGGGLVQVGDSLRLSCAASGLTFS | 678 | GYEMG | 960 | WFRQAPGKERAFVA | 1242 | AISQSGGTTSYAVSVKG |
| RSVPMP20G8 | 397 | EVQLVESGGGLVQAGDSLRLSCAASGLTFS | 679 | GYEMG | 961 | WFRQAPGKERAFVA | 1243 | AISQSGGTTSYAVSVKG |

TABLE B-1-continued

| Preferred combinations of CDR sequences, preferred combinations of framework sequences, and preferred combinations of framework and CDR sequences. | | | | | | | | |
|---|---|---|---|---|---|---|---|---|
| RSVPMP2D3 | 398 | EVQLVESGG GLVQAGDSLR LSCAASGLTFS | 680 | GYEMG | 962 | WFRQAP GKERAF VA | 1244 | AISQSG GTTSYA VSVKG |
| RSVPMP2G5 | 399 | EVQLVESGG GLVQAGDSLR LSCAASGLTFS | 681 | GYEMG | 963 | WFRQAP GKERAF VA | 1245 | AISQSG GTTSYA VSVKG |
| RSVPMP2A6 | 400 | EVQLVESGG GLVQPGGSL RLSCAASGFA FS | 682 | TYAMG | 964 | WVRQAP GKGLEW VS | 1246 | CISNGGL RTMYAD SVKG |
| RSVPMP3A2 | 401 | EVQLVESGG GLVQAGGSL RLSCEASGRT FS | 683 | SNAMG | 965 | WFRQAP GKEREF VA | 1247 | AVTRWS GARTVY ADSVKG |
| RSVPMP4A8 | 402 | EVQLVESGG GLVQAGGSL RLSCEASGRT FS | 684 | SYDMG | 966 | WFRQAP GKEREF VA | 1248 | AVTRWS GARGVY ADSVKG |
| RSVPMP4F9 | 403 | EVQLVESGG GLVQAGGSL RLSCEASGRT FS | 685 | NYAMG | 967 | WFRQAP GKEREF VA | 1249 | VVSRWS GGRTLY ADSVKG |
| RSVPMP1A6 | 404 | EVQLVESGG GLVQAGGSL RLSCAASGRT FS | 686 | SYAMG | 968 | WFRQAP GKEREF VA | 1250 | AIWWSG GSTYYA DSVKG |
| RSVPMP3C2 | 405 | EVQLVESGG GLVQAGGSL RLSCAASGRT FS | 687 | PYAMG | 969 | WFRQAP GKEREF VA | 1251 | AISWSG GTTYYA DSVKG |
| RSVPMP4H9 | 406 | EVQLVESGG GLVQAGGSL RLSCTASGRT FS | 688 | SYAMG | 970 | WFRQAP GKERDF VA | 1252 | AISWSG GSTYYA DSVKG |
| RSVPMP4B10 | 407 | KVQLVESGG GLVQAGGSL RLSCEASGGS FS | 689 | SYAMG | 971 | WFRQAP GKEREF VA | 1253 | AISGWIG PRPVYA DSVKG |
| 203B1 | 2431 | EVQLVESGG DLVQPGGSLR LSCAASGFTFR | 2449 | GYWMT | 2467 | WVRQAP GKGLEW VS | 2485 | SINNVGE ETYYVD SVKG |
| 203B2 | 2432 | EVQLVESGG DLVQPGGSLR LSCAASGFTFR | 2450 | GYWMT | 2468 | WVRQAP GKGLEW VS | 2486 | SINNIGE EAYYVD SVKG |
| 203G1 | 2433 | EVQLVESGG DLVQPGGSLR LSCAASGFTFS | 2451 | GYWMT | 2469 | WVRQAP GKGLEW VT | 2487 | SINNIGE ETYYVD SVKG |
| 203H1 | 2434 | EVQLVESGG GVVQAGGSL RLSCAASGLT FD | 2452 | IYSMG | 2470 | WFRQQ PGKERE FVA | 2488 | SIGRSG NSTNYA SSVKD |
| 203E12 | 2435 | EVQLVESGG GLVQPGGSL RLSCAASGFT FR | 2453 | GYWMS | 2471 | WVRQAP GKGLEW VS | 2489 | AINNVG DEVYYA DSVKG |
| 203E1 | 2436 | EVQLMESGG GLVQAGGSL RLSCVAPGRI FS | 2454 | SYTMG | 2472 | WFRQAP GKERDF VA | 2490 | AISTVGS TYYSDS VKG |

TABLE B-1-continued

Preferred combinations of CDR sequences, preferred combinations of framework sequences, and preferred combinations of framework and CDR sequences.

| | | | | | | | | |
|---|---|---|---|---|---|---|---|---|
| 203A12 | 2437 | EVQLVESGG GLVQAGDSLT LSCIDSGRTFS | 2455 | DYPIG | 2473 | WFRQAP GKEREF VA | 2491 | AIYAIGG DVYYAD SVKG |
| 203A9 | 2438 | EVQLVESGG GLVQAGDSLR LSCIDSGRTFS | 2456 | DYPIG | 2474 | WFRQAP GKEREF VA | 2492 | AIYPTDD NPTGPN AYYADS VKG |
| 203B12 | 2439 | EVQLVESGG GLVQPGGSL RLSCAASGFT FS | 2457 | SYAMG | 2475 | WVRRAP GEGLEW VS | 2493 | SISSGGA LPTYAD SVKG |
| 203D2 | 2440 | EVQLVESGG GLVQAGGSL RLSCAASGST GS | 2458 | STAMG | 2476 | WSRQAP GKQRE WVA | 2494 | SISSAGT IRYVDSV KG |
| 203D9 | 2441 | EVQLVESGG GWVQAGDSL RLSCAASGRT LS | 2459 | SYAMA | 2477 | WFRQAP GKERDF VT | 2495 | GITWNG GSTYYA DSVKG |
| 203G3 | 2442 | EVQLVESGG DLVQPGGSLR LSCAASGFTFR | 2460 | GYWMT | 2478 | WVRQAP GKGLEW VS | 2496 | SINNIGD EPYYVD SVKG |
| 203G9 | 2443 | EVQLVESGG GLVQPGGSL RLSCTASGFT FS | 2461 | SYWMD | 2479 | WVRQTP GKGLEY VS | 2497 | GISPSG GNTDYA DSVKG |
| 203G10 | 2444 | EVQLVESGG GWVQAGDSL RLSCAASGRT LS | 2462 | SYAMA | 2480 | WFRQAP GKERDF VT | 2498 | GITWNG GSTYYA DSVKG |
| 203H9 | 2445 | EVQLVESGG GLVQPGGSL RLSCTGSGFT FS | 2463 | SYWMD | 2481 | WVRQTP GKDLEY VS | 2499 | GISPSG GNTDYA DSVKG |
| 203H10 | 2446 | EVQLVESGG GLVQAGDSLR LSCIDSGRTFS | 2464 | DYPIG | 2482 | WFRQAP GKEREF VA | 2500 | AIYAIGG DVYYAD SVKG |
| 202E4 | 2447 | EVQLVESGG GLVQAGGSL RLSCAASVSA FS | 2465 | EYAMG | 2483 | WYRQAP GKQREF VA | 2501 | TINSLGG TSYADS VKG |
| 189E2 | 2448 | KVQLVESGG GLVQPGGSL RLSCAASGSI FS | 2466 | INAMG | 2484 | WYRQAP GKQREL VA | 2502 | HIASSGS TIYADSV KG |
| PRSVPMP20C3 | 2574 | EVQLVESGG GLVQAGGSL RLSCAASRSI FS | 2582 | FNTMG | 2590 | WYRQAP GKQREL VA | 2598 | DITSGGS TVYADS VKG |
| PRSVPMP20C5 | 2575 | EVQLVESGG GLVQPGGSL RLSCAASGSI FS | 2583 | INAMG | 2591 | WHRQAL GKQREL VA | 2599 | QSSSGG STYYAD SAKG |
| PRSVPMP20B2 | 2576 | EVQLVESGG GLVQAGGSL RLSCEASGRT FS | 2584 | SYDMG | 2592 | WFRQAP GKEREF VA | 2600 | AVTRWS GARGVY ADSVKG |
| PRSVPMP20C1 | 2577 | EVQLVESGG GLVQAGGSL RLSCAASGRT FS | 2585 | SFAMG | 2593 | WFRQAP GKEREF VA | 2601 | AISWSG GSTYYA DSVKG |

TABLE B-1-continued

Preferred combinations of CDR sequences, preferred combinations of framework sequences, and preferred combinations of framework and CDR sequences.

| | | | | | | | | |
|---|---|---|---|---|---|---|---|---|
| PRSVPMP1G8 | 2578 | EVQLVESGGGSVQAGGSLRLSCAASGGSFN | 2586 | RFGMG | 2594 | WFRRAPGKERDFVA | 2602 | AINLSGDTTYYVDSVQG |
| PRSVNMP1A4 | 2579 | EVQLVESGGGLVQAGGSLSISCAASGGSLS | 2587 | NYVLG | 2595 | WFRQAPGKEREFVA | 2603 | AINWRGDITIGPPNVEG |
| PRSVPMP13E12 | 2580 | EVQLVESGGGLVQAGGSLRLSCAASGRTFS | 2588 | RYIMG | 2596 | WFRQAPGKEREFVG | 2604 | AISRSGDITSFADFVKG |
| PRSVPMP5C6 | 2581 | EVQLVESGGGLVQAGASLRLSCAASGLAFS | 2589 | RYAMG | 2597 | WFRQAPGKERESVA | 2605 | AISSSGDNIYYADSVKG |
| LG203E7 | 2682 | EVQLVESGGGLVQPGESLRLSCAFSGIVFE | 2718 | FYDMG | 2754 | WYRQAPGMQRELVA | 2790 | NIASGGSTNLADAVKG |
| LG203G8 | 2683 | EVQLVESGGGLVQPGESLRLSCAFSGIVFE | 2719 | FYDMG | 2755 | WYRQAPGKQRELVA | 2791 | NIASRGSTDLADSVKG |
| LG211A10 | 2684 | EVQLVESGGGLAQAGGSLRLSCAVSGEAVG | 2720 | SSATG | 2756 | WYRAVSATERELVA | 2792 | RIRSGGSTDYADSVKG |
| LG211A8 | 2685 | EVQLVESGGGLVQAGGSLRLSCAASGRTLS | 2721 | SYRLG | 2757 | WFRQAPGKEREFIS | 2793 | TISWNGRSTYYADSVKG |
| LG211B10 | 2686 | EVQLVESGGDLVQAGGSLRLSCVASGSTYS | 2722 | INAMG | 2758 | WYRQAPGKLRELVA | 2794 | AFRTGGSTDYADSVKG |
| LG211B8 | 2687 | EVQLVESGGGLVQAGGSLRLSCAASGRTLS | 2723 | SYRLG | 2759 | WFRQAPGKEREFIS | 2795 | TISWNGRSTYYADSVKG |
| LG211C12 | 2688 | EVQLVESGGGLVQAGGSLRLSCTVSGDTFD | 2724 | NSAAG | 2760 | WYRATSETQRELVA | 2796 | RIRSSGSTNYADSVKG |
| LG211C8 | 2689 | EVQLVESGGGSVQAGGSLRLSCAASGGTFN | 2725 | PYVMA | 2761 | WFRQAPGNEREFVA | 2797 | RIRWSGGDAYYDDSVKG |
| LG211D10 | 2690 | EVQLVESGGGLVQAGGSLRLSCAASGRTVS | 2726 | SYYMG | 2762 | WFRQAPGNEREFVA | 2798 | AFSWSSSKPYYADSVKG |
| LG211D8 | 2691 | EVQLVESGGGLVQAGGSLRLSCAASGRAFS | 2727 | RYYMG | 2763 | WFRQAPGKEREVVA | 2799 | AFSWSGGMTYYADSVKG |
| LG211E10 | 2692 | EVQLVESGGGLVQAGGSLRLSCAASGRTVS | 2728 | SYYMG | 2764 | WFRQAPGNEREFVA | 2800 | AFSWSGSKPYYADSVKG |
| LG211E12 | 2693 | EVQLVESGGGLVQAGGSLRLSCAASGRTLS | 2729 | SYRLS | 2765 | WFRQAPGKEREFVA | 2801 | THSWDGRRTYYADSVKG |

TABLE B-1-continued

Preferred combinations of CDR sequences, preferred combinations of framework sequences, and preferred combinations of framework and CDR sequences.

| | | | | | | | | |
|---|---|---|---|---|---|---|---|---|
| LG211E8 | 2694 | EVQLVESGGGLVQAGGSLRLSCAASGRAFS | 2730 | RYYMG | 2766 | WFRQAPGKEREVVA | 2802 | AFSWSGGMTYYADSVKG |
| LG211H8 | 2695 | EVQLVESGGGLVQAGGSLRLSCAASGRTLS | 2731 | SYRLG | 2767 | WFRQAPGKEREFIS | 2803 | TISWNGRSTYYADSVKG |
| LG212A10 | 2696 | EVQLVESGGGLVQAGGSLRLSCTVSGDTFD | 2732 | NSAAG | 2768 | WYRATSETQRELVA | 2804 | RIRSSGSTNYADSVKG |
| LG212A12 | 2697 | EVQLVESGGGLVQAGGSLRLSCAVSGDTFD | 2733 | NSAAG | 2769 | WYRATSETQRELVA | 2805 | RIRSSGSTNYADSVKG |
| LG212A2 | 2698 | EVQLVESGGGLVQAGGSLRLSCAASGRTFD | 2734 | TYFVG | 2770 | WFRQAPGKERDFVA | 2806 | AISWSGDRTFYADSVKG |
| LG212A8 | 2699 | EVQLVESGGGSVQAGGSLRLSCAASGGTFN | 2735 | PYVMA | 2771 | WFRQAPGNEREFVA | 2807 | RIRWSGGDAYYDDSVKG |
| LG212B12 | 2700 | EVQLVESGGGLVQPGGSLRLSCAASGFTFG | 2736 | NYDMS | 2772 | WVRQAPGKGPEWVS | 2808 | GINTGGSTLYADSVKG |
| LG212B2 | 2701 | EMQLVESGGGLVQAGDSLRLSCAASGDTFS | 2737 | WYVMA | 2773 | WFRQAPGKEREFVT | 2809 | WINRSGASTYYADSVKG |
| LG212C12 | 2702 | EVQLVESGGGLVQPGGSLRLSCAASGFTFG | 2738 | SSDMS | 2774 | WVRQAPGKGPEWVS | 2810 | GINSGGGRTLYADSVKG |
| LG212D10 | 2703 | EVQLVESGGGSVQAGGSLRLSCAASGGTFN | 2739 | PYVMA | 2775 | WFRQAPGNEREFVA | 2811 | RIRWSGGDAYYDDSVKG |
| LG212D12 | 2704 | EVQLVESGGGSVQAGGSLRLSCAASGGTFN | 2740 | PYVMA | 2776 | WFRQAPGNEREFVA | 2812 | RIRWSGGDAYYDDSVKG |
| LG212D2 | 2705 | EVQLVESGGGLVQPGGSLRLSCAASGFTFG | 2741 | SSDMS | 2777 | WVRQAPGKGPEWVS | 2813 | GINSGGGITDYANSVKG |
| LG212E10 | 2706 | EVQLVESGGDLVQAGGSLRLSCVASGSTYS | 2742 | INAMG | 2778 | WYRQAPGKLRELVA | 2814 | AFRTGGSTDYADSVKG |
| LG212E12 | 2707 | EVQLVESGGGLVQAGGSLRLSCAASGGTFS | 2743 | PYVMA | 2779 | WFRQAPGNEREFVA | 2815 | RIRWSSINTAYDDSVKG |
| LG212E6 | 2708 | EVQLVESGGGLVQPGGSLRLSCEASGFTFG | 2744 | SRDMH | 2780 | WVRQAPGKGGPEWV | 2816 | SGINSGASNTHYADSVKG |

TABLE B-1-continued

Preferred combinations of CDR sequences, preferred combinations of framework sequences, and preferred combinations of framework and CDR sequences.

| | | | | |
|---|---|---|---|---|
| LG212F10 | 2709 EVQLVESGG GSVQAGGSL RLSCAASGGT FN | 2745 PYVMA | 2781 WFRQAP GNEREF VA | 2817 RIRWSG GDAYYD DSVKG |
| LG212F12 | 2710 EVQLVESGG GLAQAGGSL RLSCAVSGEA VG | 2746 SSATG | 2782 WYRAVS ATEREL VA | 2818 RIRSGG STDYAD SVKG |
| LG212F6 | 2711 EVQLVESGG GLVQPGGSL RLSCAASGFT FG | 2747 SYDMS | 2783 WVRQAP GKGSE WVS | 2819 HINTGG GSTTYA DSVKG |
| LG212F8 | 2712 EVQLVESGG DLVQAGGSLR LSCVASGSTYS | 2748 INAMG | 2784 WYRQAP GKLREL VA | 2820 AFRTGG STDYAD SVKG |
| LG212G10 | 2713 EVQLVESGG GSVQAGGSL RLSCAASGGT FN | 2749 PYVMA | 2785 WFRQAP GNEREF VA | 2821 RIRWSG GDAYYD DSVKG |
| LG212G2 | 2714 EVQLVESGG GLVQPGGSL RLSCAASGFT FG | 2750 SHDMS | 2786 WVRQAP GKGSE WVS | 2822 GIKSGG GSTLYA DSVKG |
| LG212H10 | 2715 EVQLVESGG GSVQAGGSL RLSCAASGGT FN | 2751 PYVMA | 2787 WFRQAP GNEREF VA | 2823 RIRWSG GDAYYD DSVKG |
| LG212H2 | 2716 EVQLVESGG GLVQAGGSL RLSCAASGRT FD | 2752 TYFVG | 2788 WFRQAP GKERDF VA | 2824 AISWSG DRTFYA DSVKG |
| LG212H8 | 2717 EVQLVESGG GLVQAGGSL RLSCTSSGSI FN | 2753 FIMG | 2789 WYRQAP GKQREL VA | 2825 DITRGDE RNYLDA VKG |
| IV121 | 3064 QVQLQESGG GLVQPGGSL RLSCTASRTD IS | 3129 FNPMA | 3194 WYRQAP GQQREL VA | 3259 SITSGGT TNYANS VKG |
| IV122 | 3065 QVQLQQSGG GLVQPGGSL RLSCAASRSD FA | 3130 FNPMG | 3195 WYRQAP GKQREL VA | 3260 VLTTGG TTNYAD SVKG |
| IV123 | 3066 QVQLQESGG GLVQPGGSL RLSCAASRSG FS | 3131 FNPMG | 3196 WYRQAP GKQREL VA | 3261 TITSGGT TNYADS VKG |
| IV126 | 3067 QVQLQESGG GLVQPGGSL RLSCAASRTD IS | 3132 FNPMG | 3197 WYRQAP GKQREL VA | 3262 TMTSGG TTGYAD SVKG |
| IV127 | 3068 QVQLQESGG GLVQPGGSL RLSCAASRSG FV | 3133 FNPMG | 3198 WYRQAP GKQREL VA | 3263 VITASLT TNYADS VKG |
| IV131 | 3069 QVQLQQSGG GLVQAGGSL RLSCAASGSG FS | 3134 FNPMG | 3199 WYRQAP GKQREL VA | 3264 SITSGGT TNYVDS VKG |

TABLE B-1-continued

Preferred combinations of CDR sequences, preferred combinations of framework sequences, and preferred combinations of framework and CDR sequences.

| | | | | | | | | |
|---|---|---|---|---|---|---|---|---|
| IV132 | 3070 | QVQLQESGG GLVQPGGSL RLSCAASVSG FI | 3135 | FNPMG | 3200 | WYRQA RGKQRE EVA | 3265 | VLTTGG TTKYAD SVKD |
| IV133 | 3071 | QVQLQQSGG GLVQPGGSL RLSCAASSSG FS | 3136 | FNPMG | 3201 | WYRQAP GKQREL VA | 3266 | TMTSGG TTNYAD SVKG |
| IV134 | 3072 | QVQLQESGG GLVQAGGSL RLSCAASGSG FS | 3137 | FNPMG | 3202 | WYRQAP GKQREL VA | 3267 | SITSGGT TNYVDS VKG |
| IV135 | 3073 | QVQLQQSGG GLVQPGGSL RLSCAASRGD IS | 3138 | FNPMG | 3203 | WYRQAP GKQREL VA | 3268 | TITNGGT TNYADS VKG |
| IV136 | 3074 | QVQLQESGG GLVQPGGSL RLSCAASRSG FS | 3139 | FNPMG | 3204 | WYRQAP GKQREL VA | 3269 | TITSGGT TNYADS VKG |
| IV140 | 3075 | QVQLQESGG GLVQPGGSL RLSCAASRSD FA | 3140 | FNPMG | 3205 | WYRQAP GKQREL VA | 3270 | VLTTGG TTNYAD SVKG |
| IV144 | 3076 | QVQLQQSGG GLVQAGGSL RLSCAASGNIIS | 3141 | FNPMG | 3206 | WHRQA PGKQRE LVA | 3271 | SITSGGS ISYVDSV KG |
| IV156 | 3077 | QVQLQQSGG GLVQPGGSL RLSCAASRSG FS | 3142 | FNPMG | 3207 | WYRQAP GKQREL VA | 3272 | TITSGGT TNYADS VKG |
| IV157 | 3078 | QVQLQQSGG GLVQPGGSL RLSCAASRSD IS | 3143 | FNPMG | 3208 | WYRQAP GKQREL VA | 3273 | TISNGGT TNYADS VKG |
| IV160 | 3079 | QVQLQESGG GLVQPGGSL RLSCAASRSD IS | 3144 | FNPMG | 3209 | WYRQAP GKQREL VA | 3274 | TISNGGT TNYADS VKG |
| IV124 | 3080 | QVQLQESGG GLVQPGGSL RLSCAASGSI FS | 3145 | INRMG | 3210 | WYRQAP GKQREL VA | 3275 | AITYGGS TNYADS VKG |
| IV125 | 3081 | QVQLQQSGG GLVQAGGSL RLSCAASGSA FS | 3146 | INTMG | 3211 | WYRQAP GKQREL VA | 3276 | VISSGSG GSTNYA DSVKG |
| IV145 | 3082 | QVQLQQSGG GLVQPGGSL RLSCAASGST FS | 3147 | INAMG | 3212 | WYRQAP GKQREL VA | 3277 | AISSGGS TNYADS VKG |
| IV146 | 3083 | QVQLQQSGG GLVQAGGSL RLSCAASGSS FS | 3148 | INAMG | 3213 | WYRQAP GKQREL VA | 3278 | AISSGGS ANYADS VKG |
| IV147 | 3084 | QVQLQESGG GLVQAGGSL RLSCAASGST FS | 3149 | INAMG | 3214 | WYRQAP GKQREL VA | 3279 | AISSGGS TNYADS VKG |

TABLE B-1-continued

Preferred combinations of CDR sequences, preferred combinations of framework sequences, and preferred combinations of framework and CDR sequences.

| | | | | | | | | |
|---|---|---|---|---|---|---|---|---|
| IV151 | 3085 | QVQLQESGG GLVQAGDSLR LSCAASGRTFN | 3150 | SLTMA | 3215 | WFRQAP GKDRDF VS | 3280 | VVNWDG DRTNYA DSVKG |
| IV153 | 3086 | QVQLQESGG GLVQAGGSL RLSCAFSGDT FS | 3151 | FYTLG | 3216 | WFRQAP GKEREF VA | 3281 | ATSNIGG YIYYGDS VKG |
| IV154 | 3087 | QVQLQESGG GLVQAGGSL RLSCAASGRP FS | 3152 | SAAMG | 3217 | WFRQAP GKEREF VS | 3282 | AISYTGD VTRYAD SVKG |
| IV155 | 3088 | QVQLQESGG GLVQAGGSL RLSCAASGRS LS | 3153 | RYAMG | 3218 | WFRQAP GKEREF VA | 3283 | TKTSGG VTYYGA SVKG |
| IV1 | 3089 | QVQLQESGG GLVETGGSLR LSCAASGRTFG | 3154 | GYALA | 3219 | WFRQAP GKGREF VA | 3284 | AVTWTS GTTNYA GSVKD |
| IV2 | 3090 | QVQLQESGG GLVQTGGSLR LSCAASGRTFG | 3155 | GYAMA | 3220 | WFRQAP RKGREF VA | 3285 | SVTWNG GATDYA GSVKD |
| IV3 | 3091 | QVQLQESGG GLVQTGGSLR LSCAASGRTFG | 3156 | GYAMA | 3221 | WFRQVP GKGREF VA | 3286 | AVTWSS GTTNYA RSVKD |
| IV4 | 3092 | QVQLQESGG GLVQTGGSLR LSCAASGRTFG | 3157 | GYAMA | 3222 | WFRQAP GKGREF VA | 3287 | AVTWSS GTTNYA GSVKD |
| IV6 | 3093 | QVQLQESGG GLVQTGGSLR LSCAASGRTFG | 3158 | GYAMA | 3223 | WFRQAP GKGREF VA | 3288 | AVTWSA GTTNYA GSVKD |
| IV7 | 3094 | QVQLQQSGG GLVQTGGSLR LSCAASGRTFG | 3159 | GYAMA | 3224 | WFRQAP GKGREF VA | 3289 | AVTWSA GTTNYA GSVKD |
| IV9 | 3095 | QVQLQESGG GLVQTGGSLR LSCAASGRTFG | 3160 | GYAMA | 3225 | WFRQAP GKGREF VA | 3290 | AVTWSA GTTNYA GSVKD |
| IV10 | 3096 | QVQLQESGG GLVQAGGSL RLSCATSGRP FG | 3161 | GYAMA | 3226 | WFRQAP GKGREF VA | 3291 | AVTWSA GTTNYA GSVKD |
| IV11 | 3097 | QVQLQESGG GLVQAGGSL RLSCAASGRT FG | 3162 | GYAMA | 3227 | WFRQAP GKGREF VA | 3292 | AVTWSS GTTNYA GSVKD |
| IV12 | 3098 | QVQLQQSGG GLVQTGGSLR LSCAASGRTFG | 3163 | GYAMA | 3228 | WFREAP GKGREF VA | 3293 | AVTWSS GTTNYA GSVKD |
| IV16 | 3099 | QVQLQESGG GLVQTGGSLR LSCAASGRTFG | 3164 | GYAMA | 3229 | WFRQAP GKGREF VA | 3294 | AVTWSS GTTNYA GSVKD |
| IV24 | 3100 | QVQLQESGG GLVQTGGSLR LSCAASGRTFG | 3165 | GYAMA | 3230 | WFRQAP GKGREF VA | 3295 | AITWSA GTTNYA DSMKD |
| IV26 | 3101 | QVQLQESGG GLVRTGDSLR LSCAASGRTFN | 3166 | GYAMA | 3231 | WFRQAP GKGREF VA | 3296 | AVTWSS GTTNYA GSVKD |
| IV30 | 3102 | QVQLQESGG GLVETGGSLR LSCAASGRTFG | 3167 | GYAMA | 3232 | WFRQAP GKGREF VA | 3297 | AVTWTS GTTNYA GSVKD |

TABLE B-1-continued

Preferred combinations of CDR sequences, preferred combinations of framework sequences, and preferred combinations of framework and CDR sequences.

| | | | | | | | | |
|---|---|---|---|---|---|---|---|---|
| IV34 | 3103 | QVQLQESGG GLVQTGGSLR LSCAASGGTFG | 3168 | GYAMA | 3233 | WFRQAP GKGREF VA | 3298 | SVIWNG GTTNYL DSVKD |
| IV14 | 3104 | QVQLQESGG GLVQAGGSL RLSCAASGRT LN | 3169 | NYAMG | 3234 | WFRQAP GAEREF VG | 3299 | AISASGD STQYTE SVQG |
| IV15 | 3105 | QVQLQQSGG GLVQAGGSL RLSCAASGGT LN | 3170 | NYAMG | 3235 | WFRQAP GAEREF VG | 3300 | AISAGG DSTQYT ESVQG |
| IV17 | 3106 | QVQLQESGG GLVQAGGSL RLSCAASGRT LN | 3171 | NYAMG | 3236 | WFRQAP GAEREF VG | 3301 | AISASGD STQYTE SVQG |
| IV18 | 3107 | QVQLQQSGG GLVQAGGSL RLSCAASGRT LN | 3172 | NYAMG | 3237 | WFRQAP GAEREF VG | 3302 | AISASGD STQYTE SVQG |
| IV29 | 3108 | QVQLQESGG GLVQAGGSL RLSCVASGRT LD | 3173 | NYAMG | 3238 | WFRQAP GAEREF VG | 3303 | AISANGE DTQYTE SVQG |
| IV31 | 3109 | QVQLQQSGG GLVQAGGSL RLSCAASGRT LN | 3174 | NYAMG | 3239 | WFRQAP GAEREF VG | 3304 | AISASGD STQYTE SVQG |
| IV33 | 3110 | QVQLQQSGG GLVQAGGSL RLSCAASGRT LN | 3175 | NYAMG | 3240 | WFRQAP GAEREF VG | 3305 | AISASGD STQYTE SVQG |
| IV35 | 3111 | QVQLQESGG GLVQAGGSL RLSCAASGRT LN | 3176 | NYAMG | 3241 | WFRQAP GAEREF VG | 3306 | AISASGD STDYTE SVQG |
| IV36 | 3112 | QVQLQESGG GLVQAGGSL RLSCAASGRT LN | 3177 | NYAMG | 3242 | WFRQAP GAEREF VG | 3307 | AISASGD STQYTE SVQG |
| IV40 | 3113 | QVQLQESGG GLVQAGGSL RLSCAASGHT LN | 3178 | NYAMG | 3243 | WFRQG PGAERE FVG | 3308 | AISASGD STQYTE SVQG |
| IV42 | 3114 | QVQLQQSGG GLVQAGESLR LSCAASGRTLN | 3179 | NYAMG | 3244 | WFRQAP GAEREF VG | 3309 | AISASGD STQYTE SVQG |
| IV8 | 3115 | QVQLQESGG GLVQAGGFLR LSCAASGRSFN | 3180 | TYAMG | 3245 | WFRQAP GKEREF VA | 3310 | GITRSGT ATDYAD SVKG |
| IV21 | 3116 | QVQLQQSGG GLVQAGGFLR LSCAASGRSFN | 3181 | TYAMG | 3246 | WFRQAP GKEREF VA | 3311 | GITRSGT ATDYIDS VKG |
| IV23 | 3117 | QVQLQESGG GLVQAGGFLR LSCAASGRSFN | 3182 | TYAMG | 3247 | WFRQAP GKEREF VA | 3312 | GITRSGT ATDYIDS VKG |
| IV45 | 3118 | QVQLQQSGG GLVQAGGFLR LSCAASGRSFN | 3183 | TYAVG | 3248 | WFRQAP GKEREF VA | 3313 | GITRSGT ATDYAD SVKG |

TABLE B-1-continued

Preferred combinations of CDR sequences, preferred combinations of framework sequences, and preferred combinations of framework and CDR sequences.

| | | | | | | | | |
|---|---|---|---|---|---|---|---|---|
| IV47 | 3119 | QVQLQQSGG GLVQAGGFLR LSCAASGRSFN | 3184 | TYAMG | 3249 | WFRQAP GKEREF VA | 3314 | GITRSGT ATEYAD SVKG |
| IV48 | 3120 | QVQLQESGG GLVQAGGFLR LTCAASGRSFN | 3185 | TYAMG | 3250 | WFRQAP GKDRKF VA | 3315 | GITRSGT VTDYAD SVKG |
| IV50 | 3121 | QVQLQESGG GLVQAGGFLR LSCAASGRSFN | 3186 | TYAMG | 3251 | WFRQAP GKEREF VA | 3316 | GITRSGT ATDYAD SVKG |
| IV22 | 3122 | QVQLQESGG GLVQAGDSLR LSCAASGPSFN | 3187 | NGAMS | 3252 | WFRQAP GKEREF VA | 3317 | AIRWSG GGIRYA DSVKG |
| IV37 | 3123 | QVQLQESGG GLVQAGDSLR LSCAAPGRSFS | 3188 | GGAMS | 3253 | WFRQVP GKEREF VA | 3318 | AIRWSG GGIRYA DSVKG |
| IV38 | 3124 | QVQLQESGG GLVQAGGSL RLSCAASGPS FN | 3189 | NGAMS | 3254 | WFRQAP GKEREF VA | 3319 | AIRWSG GGIRYA DSVKG |
| IV5 | 3125 | QVQLQQSGG GLVQAGGSL RLSCAASGRT FS | 3190 | TTGMG | 3255 | WFRQAP GKEREF VA | 3320 | AFWWT GGQTFY ADSVKG |
| IV27 | 3126 | QVQLQESGG GLVQAGGSL RLSCAASGST FS | 3191 | TYAMG | 3256 | WFRQAP GKEREF VA | 3321 | AFWWTD EQTFYA DSVKG |
| IV25 | 3127 | QVQLQQSGG GLVQSGGSLS LSCAASGITLN | 3192 | NRVVG | 3257 | WFRQAP GKEREF VG | 3322 | RIMWSV GDTFYA RSVKG |
| IV28 | 3128 | QVQLQESGG GLVQPGGSL RLSCSASGFA FD | 3193 | DYAMS | 3258 | WVRQAP GKGLEW VS | 3323 | SINWNG GSTYYA ESMKG |

| Clone | ID | FR3 | ID | CDR3 | ID | FR4 | ID |
|---|---|---|---|---|---|---|---|
| LG202A10 | 1254 | RFTISRDNA KNTVYLQMS SLKPEDTAIY SCAV | 1536 | ASGGGS IRSARR YDY | 1818 | WGRGT QVTVSS | 2100 |
| LG202A12 | 1255 | RFTISRDNA KNTVYLQMN SLKPEDTAV YYCAA | 1537 | DDQKYD YIAYAEY EYDY | 1819 | WGQGT QVTVSS | 2101 |
| LG202A5 | 1256 | RFTISRDNA KNTLYLQMN SLKSEDTAV YYCVK | 1538 | DWASD YAGYSP | 1820 | NSQGT QVTVSS | 2102 |
| LG202A9 | 1257 | RFTISRDNA KNMLYLQM NSLKAEDTA VYYCAR | 1539 | DWHND PNKNEY | 1821 | KGQGT QVTVSS | 2103 |
| LG202B10 | 1258 | RFTISRDNA KNTLYLQMN SLKSEDTAV YYCTR | 1540 | DWYND PNKNEY | 1822 | KGQGT QVTVSS | 2104 |
| LG202B7 | 1259 | RFTISRDNA KNTLYLQMN SLKSEDTAV YYCTR | 1541 | DWFDD PNKNEY | 1823 | KGQGT QVTVSS | 2105 |

TABLE B-1-continued

Preferred combinations of CDR sequences, preferred combinations of framework sequences, and preferred combinations of framework and CDR sequences.

| | | | | | | | |
|---|---|---|---|---|---|---|---|
| LG202B8 | 1260 | RFTISRDNA KNTLYLQMN SLRSEDTAV YYCTR | 1542 | DWHSD PNKHEY | 1824 | RGQGT QVTVSS | 2106 |
| LG202B9 | 1261 | RFTISRDNA KNMLYLQM NSLKAEDTA YYCTR | 1543 | DWYDD PNKNEY | 1825 | KGQGT QVTVSS | 2107 |
| LG202C1 | 1262 | RFTISRDNA KNTLYLQMN SLKSEDTAV YYCVK | 1544 | DWASD YAGYSP | 1826 | NSQGT QVTVSS | 2108 |
| LG202C11 | 1263 | RFTISRDNA KNMLYLQM NSLKAEDTA VYYCAR | 1545 | DWHND PNKNEY | 1827 | KGQGT QVTVSS | 2109 |
| LG202C2 | 1264 | RFTISRDNA KNTLYLQMN SLKSEDTAV YYCVK | 1546 | DWASD YAGYSP | 1828 | NSQGT QVTVSS | 2110 |
| LG202C7 | 1265 | RFTIARDNT KRTLYLQMN SLKSEDTAV YYCTR | 1547 | DWHSE PNKYEY | 1829 | KGQGT QVTVSS | 2111 |
| LG202C8 | 1266 | RFTISRDNA KNTLYLQMN SLKPEDTAL YYCRR | 1548 | SLTLTD SPDL | 1830 | RSQGT QVTVSS | 2112 |
| LG202C9 | 1267 | RFTISRDNA KNALYLQMN SLKSEDTAV YYCAR | 1549 | DWYND PNKNEY | 1831 | KGQGT QVTVSS | 2113 |
| LG202D5 | 1268 | RFTISRDNA KNTGYLQM NSLKPEDTA VYYCYV | 1550 | VGNFTTY | 1832 | WGRGT QVTVSS | 2114 |
| LG202D7 | 1269 | RFTISRDNA KNMLYLQM NSLKAEDTA VYYCAR | 1551 | DWYDD PNKNEY | 1833 | KGQGT QVTVSS | 2115 |
| LG202D8 | 1270 | RFTISRDNA KNTLYLQMN SLKSEDTAV YYCTR | 1552 | DWYND PNKNEY | 1834 | KGQGT QVTVSS | 2116 |
| LG202E11 | 1271 | RFTISRDNA KNTLYLQMN SLKSEDTAV YYCTR | 1553 | DWYND PNKNEY | 1835 | KGQGT QVTVSS | 2117 |
| LG202E2 | 1272 | RFSISRDNA KNTLYLQMN SLKSEDTAV YYCVR | 1554 | DWASD YAGYSP | 1836 | NSQGT QVTVSS | 2118 |
| LG202E5 | 1273 | RFTISRDNA KNTLYLQMN SLKSEDTAV YYCVK | 1555 | DWASD YAGYSP | 1837 | NSQGT QVTVSS | 2119 |
| LG202E6 | 1274 | RFTISRDNA KNTVYLQMN SLKPEDTAV YYCAA | 1556 | DLSPGN EYGEM MEYEYDY S | 1838 | WGEGT QVTVSS | 2120 |

TABLE B-1-continued

Preferred combinations of CDR sequences, preferred combinations of framework sequences, and preferred combinations of framework and CDR sequences.

| | | | | | | | |
|---|---|---|---|---|---|---|---|
| LG202E7 | 1275 | RFTISRDNAKNTLYLQMNSLKSEDTAAYYCAR | 1557 | DWYNDPNKNEY | 1839 | KGQGTQVTVSS | 2121 |
| LG202F10 | 1276 | RFTISRDNAKNMLYLQMNSLKAEDTAVYYCAR | 1558 | DWYDDPNKNEY | 1840 | KGQGTQVTVSS | 2122 |
| LG202F12 | 1277 | RFTISRDNAKNTLYLQMNSLKSEDTAVYYCAR | 1559 | DWYNDPNKNEY | 1841 | KGQGTQVTVSS | 2123 |
| LG202F3 | 1278 | RFTISRDNAKNTLYLQMNSLKSEDTAVYYCVK | 1560 | DWASDYAGYSP | 1842 | NSQGTQVTVSS | 2124 |
| LG202F4 | 1279 | RFTISRDNAKNTLYLQMNSLKSEDTAVYYCVK | 1561 | DWASDYAGYSP | 1843 | NSQGTQVTVSS | 2125 |
| LG202F8 | 1280 | RFTITRDNAKNTVYLQMNSLKPEDTAVYYCAA | 1562 | DADGWWHRGQAYHW | 1844 | WGQGTQVTVSS | 2126 |
| LG202G11 | 1281 | RFTISRDNAKNTLYLQMNSLKSEDTAAYYCAR | 1563 | DWYNDPNKNEY | 1845 | KGQGTQVTVSS | 2127 |
| LG202G3 | 1282 | RFTISREDAKNTVYLQMNSLKPGDTADYYCAA | 1564 | ECAMYGSSWPPPCMD | 1846 | WGQGTQVTVSS | 2128 |
| LG202G8 | 1283 | RFTISRDNAKNMLYLQMNSLKAEDTAVYYCAR | 1565 | DWYDDPNKNEY | 1847 | KGQGTQVTVSS | 2129 |
| LG202H2 | 1284 | RFTISRDNAKNTLYLQMNSLKSEDTAVYYCVK | 1566 | DWASDYAGYSP | 1848 | NSQGTQVTVSS | 2130 |
| LG202H8 | 1285 | RFTISRDNAKNMLYLQMNSLKAEDTAVYYCAR | 1567 | DWHNDPNKNEY | 1849 | KGQGTQVTVSS | 2131 |
| LG191B9 | 1286 | RFTISGDNANNTVYLQMHSVKPEDTATYYCAA | 1568 | DTQFSGYVPKETNEYDY | 1850 | WGQGTQVTVSS | 2132 |
| LG191D3 | 1287 | RFTISRDNAENTVYLQMNSLKPEDTAVYTCAA | 1569 | ELTNRNSGAYYYAWAYDY | 1851 | WGQGTQVTVSS | 2133 |
| LG192A8 | 1288 | RFTISRDNAKNTVYLQMNSLKAEDTAVYYCAA | 1570 | RPRFWGSYEYDY | 1852 | WGQGTQVTVSS | 2134 |
| LG192B1 | 1289 | RFAISRDNAKNTVYLQMNSLKPEDTAVYYCAT | 1571 | DLTSSCPIYSGTDY | 1853 | WGKGTLVTVSS | 2135 |

TABLE B-1-continued

Preferred combinations of CDR sequences, preferred combinations of framework sequences, and preferred combinations of framework and CDR sequences.

| | | | | | | | |
|---|---|---|---|---|---|---|---|
| LG192C10 | 1290 | RFTISRDNA KNTVYLPMN SLKPEDTAV YYCAA | 1572 | APKSW GTWPLV ADTRSY HF | 1854 | WGQGT QVTVSS | 2136 |
| LG192C4 | 1291 | RFTISRDNA ENTVYLQMN SLKPEDTAV YTCAA | 1573 | DSTNRN SGAVYY SWAYDY | 1855 | WGQGT QVTVSS | 2137 |
| LG192C6 | 1292 | RFTISRDNA ENTVYLQMN SLKPEDTAV YTCAA | 1574 | DSTNRN RGAIYY TWAYDY | 1856 | WGQGT QVTVSS | 2138 |
| LG192D3 | 1293 | RFTISRDNA KKTVYLQMN TLKPEDTAV YYCAA | 1575 | DSAFGT GYSDNY YSTSEE YDY | 1857 | WGQGT QVTVSS | 2139 |
| LG191E4 | 1294 | RFTMSRDNA KNTVDLQMN SLKPEDTAL YYCAG | 1576 | SSRIYIY SDSLSE RSYDY | 1858 | WGQGT QVTVSS | 2140 |
| LG192F2 | 1295 | RFTISRDNA ENTVYLQMN SLKPEDTAV YTCAA | 1577 | DSTNRN SGAIYYT WAYDY | 1859 | WGQGT QVTVSS | 2141 |
| LG192H1 | 1296 | RFTISRDNA KNMVYLQM NSLKPEDTA VYYCNA | 1578 | GYIY | 1860 | WGQGT QVTVSS | 2142 |
| LG192H2 | 1297 | RFTISRDNA ENTVYLQMN SLKPEDTAV YTCAA | 1579 | DSTNRN SGAWY YTWAYDH | 1861 | WGQGT QVTVSS | 2143 |
| LG20610B | 1298 | RFTISGENA KNTVYLQMN SLKPEDTAV YYCAA | 1580 | KTLVGV TTAFDR | 1862 | WGQGT QVTVSS | 2144 |
| LG20610C | 1299 | RFTISRDNA NNTVYLQMD SLKPEDTAT YYCAA | 1581 | DTQYSG VVLKES TDYDY | 1863 | WGQGT QVTVSS | 2145 |
| LG20610D | 1300 | RFTISRDNA NNTVYLQMD SLKPEDTAT YYCAA | 1582 | DTQYSG VVLKES TDYDY | 1864 | WGQGT QVTVSS | 2146 |
| LG20610E | 1301 | RFTISGDNA KSTVYLQMN SLKPEDTAV YYCAV | 1583 | RGVAVT TILWNY | 1865 | WGQGT QVTVSS | 2147 |
| LG20610F | 1302 | RFTISRDNA KNTVYLQMN SLKAEDTAV YYCAA | 1584 | RPRFW GSYEYDY | 1866 | WGQGT QVTVSS | 2148 |
| LG20611D | 1303 | RFTISRDNA KNTVYLQMN SLKAEDTAV YYCAA | 1585 | RPRFW GSYEYDY | 1867 | WGQGT QVTVSS | 2149 |
| LG20611H | 1304 | RFTISRDNA KNTVYLPMN SLKPEDTAV YYCAA | 1586 | APKSW GTWPLV ADTRSY HF | 1868 | WGQGT QVTVSS | 2150 |

TABLE B-1-continued

| Preferred combinations of CDR sequences, preferred combinations of framework sequences, and preferred combinations of framework and CDR sequences. | | | | | | | | |
|---|---|---|---|---|---|---|---|---|
| LG20612F | 1305 | RFTISRDNA KNTVYLPMN SLKPEDTAV YYCAA | 1587 | APKSW GTWPLV ADTRSY HF | 1869 | WGQGT QVTVSS | 2151 |
| LG2062A | 1306 | RFTISRDNA ENTVYLQMN SLKPEDTAV YTCAA | 1588 | DSTNRN SGAWY YTWAYDH | 1870 | WGQGT QVTVSS | 2152 |
| LG2062C | 1307 | RFAISSDNA GNTVYLQM NNLQPEDTA VYYCAA | 1589 | QGSIVF YSNWD RASQYDY | 1871 | WGQGT QVTVSS | 2153 |
| LG2062E | 1308 | RFTISRDNP KNTLYLQMN SLKPEDTAL YYCAR | 1590 | NRDSGS SYITFSL ADFGS | 1872 | WGQGT QVTVSS | 2154 |
| LG2062F | 1309 | RFTISRDNA ENTVYLQMN SLKPEDTAV YTCAA | 1591 | ELTNRN SGAYYY AWAYDY | 1873 | WGQGT QVTVSS | 2155 |
| LG2062G | 1310 | RFTISRDNA ENTVYLQMN SLKPEDTAV YTCAA | 1592 | DSTNRN SGAVYY TWAYDY | 1874 | WGQGT QVTVSS | 2156 |
| LG2062H | 1311 | RFTISRDNA ENTVYLQMN SLKPEDTAV YTCAA | 1593 | DSTNRN SGAVYY TWAYDY | 1875 | WGQGT QVTVSS | 2157 |
| LG2063A | 1312 | RFTISRDNA ENTVYLQMN SLKPEDTAV YTCAA | 1594 | DSTNRN SGAVYY TWAWDY | 1876 | WGQGT QVTVSS | 2158 |
| LG2063B | 1313 | RFTISSDNA KNTVYLQMN SLKPEDTAV YYCAA | 1595 | DFSLAQ YKTIHR MPPYG MDY | 1877 | WGKGT LVTVSS | 2159 |
| LG2063C | 1314 | RFTISRDNA ENTVYLQMN SLQPEDTAV YTCAA | 1596 | DATNRN SGAYYY TWAYDY | 1878 | WGQGT QVTVSS | 2160 |
| LG2063D | 1315 | RFTISGDNA ENTVYLQMN SLKPEDTAV YTCAA | 1597 | DSTNRN SGAVYY TWAYDY | 1879 | WGQGT QVTVSS | 2161 |
| LG2063E | 1316 | RFTISRDNA ENTVYLQMN SLKPEDTAV YTCAA | 1598 | DSTNRN SGAWY YTWAYDH | 1880 | WGQGT QVTVSS | 2162 |
| LG2063F | 1317 | RFTISRDNA ENTVYLQMN SLKPEDTAV YTCAA | 1599 | ELTNRN SGAYYY TWAYDY | 1881 | WGQGT QVTVSS | 2163 |
| LG2064D | 1318 | RFTISRDNA ENTVYLQMN SLKPEDTAV YTCAA | 1600 | DSTNRN SGAIYYT WAYDY | 1882 | WGQGT QVTVSS | 2164 |
| LG2064G | 1319 | RFTISGDNA ENTVYLQMN SLKPEDTAV YTCAA | 1601 | DSTNRN SGAVYY PWAYDY | 1883 | WGQGT QVTVSS | 2165 |

TABLE B-1-continued

Preferred combinations of CDR sequences, preferred combinations of framework sequences, and preferred combinations of framework and CDR sequences.

| | | | | | | | |
|---|---|---|---|---|---|---|---|
| LG2065A | 1320 | RFTISRDNAENTVYLQMNSLKPEDTAVYTCAA | 1602 | DSTNRNSGAVYYSWAYDY | 1884 | WGQGTQVTVSS | 2166 |
| LG2065E | 1321 | RFTISRDNAENTVYLQMNSLKPEDTAVYTCAA | 1603 | DSTNRNSGAIYYTWAYDY | 1885 | WGQGTQVTVSS | 2167 |
| LG2066A | 1322 | RFTISRDNAENTVYLQMNSLKPEDTAVYTCAA | 1604 | DSTNRNSGAVYYSWAYDY | 1886 | WGQGTQVTVSS | 2168 |
| LG2066D | 1323 | RFTISRDNAKNTVYLQMNSLKPEDTAVYYCNA | 1605 | QIIPRVMPLRSNDY | 1887 | WGQGTQVTVSS | 2169 |
| LG2067B | 1324 | RFTISRDNDKNTVYLQMNSLKPEDTAVYYCKT | 1606 | RWYEGIWREY | 1888 | WGQGTRVTVSS | 2170 |
| LG2067C | 1325 | RFTVSRDNAENTLYLQMNSLESEDTAVYYCAK | 1607 | SLGTIWYQKDYRAYDA | 1889 | WGRGTQVTVSS | 2171 |
| LG2067E | 1326 | RFTISRDNAKNTVYLQMNSLKAEDTAVYYCAA | 1608 | RPRFWGSYEYDY | 1890 | WGQGTQVTVSS | 2172 |
| LG2067G | 1327 | RFTISRDNAENTVYLQMNSLKPEDTAVYFCAR | 1609 | NRQGEVFRTTRLDYDS | 1891 | WGRGTQVTVSS | 2173 |
| LG2067H | 1328 | RFTISRDNAKNTLYLQMDSLKPEDTAVYYCSK | 1610 | DRYPFVSREYDY | 1892 | RGQGTQVTVSS | 2174 |
| LG20711A | 1329 | RFSISKDSAKNTVLLQMNSLKPEDTAVYSCNL | 1611 | RQYESDRWRDY | 1893 | WGQGTQVTVSS | 2175 |
| LG20711B | 1330 | RFTISRDNAKNTVYLQMNSLKPEDTAVYYCAA | 1612 | DFSRSWGTCNEEYYYGMDY | 1894 | WGKGTLVTVSS | 2176 |
| LG20711D | 1331 | RFTISGENAKNTVYLQMNSLKPEDTAVYYCAA | 1613 | KTIVGGTTAWBR | 1895 | WGQGTQVTVSS | 2177 |
| LG20711E | 1332 | RFTISGENAKNTVYLQMNSLKPEDTAVYYCAA | 1614 | KTIVGGTTAWDR | 1896 | WGQGTQVTVSS | 2178 |
| LG20711F | 1333 | RFTISRDNAKNTLYLQMDSLKPEDTAVYYCSK | 1615 | DLYPFVSREYDY | 1897 | RGQGTQVTVSS | 2179 |
| LG20711G | 1334 | RFTISRDNAKNTVYLQMNSLKPEDAAVYYCAA | 1616 | DLDGNGSIDYGYEY | 1898 | WGQGTQVTVSS | 2180 |

TABLE B-1-continued

Preferred combinations of CDR sequences, preferred combinations of framework sequences, and preferred combinations of framework and CDR sequences.

| | | | | | | | |
|---|---|---|---|---|---|---|---|
| LG20711H | 1335 | RFTISRDNAKNTLYLQMDSLKPEDTAVYYCSK | 1617 | DRYPFISKEYDY | 1899 | RGQGTQVTVSS | 2181 |
| LG2071A | 1336 | RFTISRDNAKNMVYLQMNSLKPEDTALYFCKQ | 1618 | RQHDGGSWYDY | 1900 | WGQGTQVTVSS | 2182 |
| LG2071B | 1337 | RFTISSENAKNTVYLQMNSLKAEDTAVYYCNA | 1619 | LGRMAVAHSVSDFNS | 1901 | WGQGTQVTVSS | 2183 |
| LG2071C | 1338 | RFTMSRDNAKNTVDLQMNSLKPEDTALYYCAG | 1620 | SSRIYIYSDSLSERSYDY | 1902 | WGQGTQVTVSS | 2184 |
| LG207D1 | 1339 | RFTISRDNAENTVYLQMNSLKPEDTAVYTCAA | 1621 | ELTNRNPGAYYYTWAYDY | 1903 | WGQGTQVTVSS | 2185 |
| LG2071E | 1340 | RFTMSRDNAKNTADLQMNSLKPEDTALYYCAG | 1622 | SSRIYIYSDSLSEGSYDY | 1904 | WGQGTQVTVSS | 2186 |
| LG2071F | 1341 | RFTMSRDNAKNTVDLQMNSLKPEDTALYYCAG | 1623 | SSRIYIYSDSLSERSYDY | 1905 | WGQGTQVTVSS | 2187 |
| LG2074A | 1342 | RFTISRDNAKNTVYLQMNSLKPEDTAVYYCNA | 1624 | RGLGSHRVSDY | 1906 | WGQGTQVTVSS | 2188 |
| LG2074B | 1343 | RFTISRDNAKNTVYLQMNSLKPEDTAVYYCNA | 1625 | RGLGSHRVSDY | 1907 | WGQGTQVTVSS | 2189 |
| LG2074D | 1344 | RFTISRDDAKNAVYLQMNSLKPEDTAVYYCAA | 1626 | NPSYVYSDYLSLAGYTY | 1908 | WGQGTQVTVSS | 2190 |
| LG2074H | 1345 | RFTISRDNAKDTVYLQMNSLKPEDTAVYYCHV | 1627 | PWMDYNRRDY | 1909 | WGQGTQVTVSS | 2191 |
| LG2075A | 1346 | RFTISSENAKNTVYLQMNSLKAEDTAVYYCNA | 1628 | LGRMAVAHSVSDFNS | 1910 | WGQGTQVTVSS | 2192 |
| LG2075B | 1347 | RFTISRDNAKNTADLQMNSLKPEDTAVYYCNA | 1629 | RTLGAHGIDDY | 1911 | WGQGTQVTVSS | 2193 |
| LG2075C | 1348 | RFTMSRDNAKNTVDLQMNSLKPEDTALYYCAG | 1630 | SSRIYIYSDSLSERSYDY | 1912 | WGQGTQVTVSS | 2194 |
| LG2075D | 1349 | RFTISRDNAENTVYLQMNSLKPEDTAVYTCAA | 1631 | DSTNRNSGAWYYTWAYDH | 1913 | WGQGTQVTVSS | 2195 |

TABLE B-1-continued

Preferred combinations of CDR sequences, preferred combinations of framework sequences, and preferred combinations of framework and CDR sequences.

| | | | | | | | |
|---|---|---|---|---|---|---|---|
| LG2075E | 1350 | RFSISRHNA KNSVYLQMN SLKPEDTAV YFCNL | 1632 | KQPENH AITNY | 1914 | WGQGT QVTVSS | 2196 |
| LG2076A | 1351 | RFTISRDNA KNTVYLQMN SLKPEDTAV YYCNH | 1633 | RGAGAH RVDDY | 1915 | WGQGT QVTVSS | 2197 |
| LG2076B | 1352 | RFTISRDNA ENTVYLQMN SLKPEDTAV YTCAA | 1634 | ELTNRN SGAYYY AWAYDY | 1916 | WGQGT QVTVSS | 2198 |
| LG2076C | 1353 | RFTISRDNA KNTVYLQMN SLKPEDTAV YYCNT | 1635 | EGREAR NHGLYE YHS | 1917 | WGQGT QVTVSS | 2199 |
| LG2076D | 1354 | RFTISRDDA KNTVYLQMN SLKPEDTGV YYCNA | 1636 | RVPGAH YIMDY | 1918 | WGKGT LVTVSS | 2200 |
| LG2076E | 1355 | RFSISRHNA KNSVYLQMN SLKPEDTAV YFCNL | 1637 | KQPENH AITNY | 1919 | WGQGT QVTVSS | 2201 |
| LG2076F | 1356 | RFTISRDDA KNTVYLHMN SLKPEDTAV YYCKT | 1638 | LDN | 1920 | WGQGT QVTVSS | 2202 |
| LG2079A | 1357 | RFTISGDNA NNTVYLQMH SVKPEDTAT YYCAA | 1639 | DTQFSG YVPKET NEYDY | 1921 | WGQGT QVTVSS | 2203 |
| LG2079B | 1358 | RFTISGDNA NNTVYLQMH SVKPEDTAT YYCAA | 1640 | DTQFSG YVPKET NEYDY | 1922 | WGQGT QVTVSS | 2204 |
| LG2079C | 1359 | RFTISRDHA KNEQYLEMN SLKPEDTAV YFCTA | 1641 | RAGSGL RTTINDY TY | 1923 | WGQGT QVTVSS | 2205 |
| LG2079D | 1360 | RFTISGENA KNTVYLQMN RLKPEDTAV YYCAA | 1642 | KTLVGD TTAFDR | 1924 | WGQGT QVTVSS | 2206 |
| LG2079E | 1361 | RFTISRDNA KNTVYLQMN SLGPEDTAIY TCAA | 1643 | KENGMF ITATQE QSYDY | 1925 | WGQGT QVTVSS | 2207 |
| LG2079F | 1362 | RFTISRDNA KNTLYLQMD SLKPEDTAV YYCSK | 1644 | DLYPFV SREYDY | 1926 | RGQGT QVTVSS | 2208 |
| LG2079G | 1363 | RFTISRDNA KNTVYLQMN SLKAEDTAV YYCAA | 1645 | RPRFW GSYEYDY | 1927 | WGQGT QVTVSS | 2209 |
| LG2079H | 1364 | RFTISRDNA NNTVYLQMH SLKPEDTAT YYCAA | 1646 | DTEFSG YVQKES NDYDY | 1928 | WGQGI QVTVSS | 2210 |

TABLE B-1-continued

| Preferred combinations of CDR sequences, preferred combinations of framework sequences, and preferred combinations of framework and CDR sequences. | | | | | | | |
|---|---|---|---|---|---|---|---|
| LG213B7 | 1365 | RFTVSRDNA KNTVYLQMN SLKPEDTAV YYCNV | 1647 | VSYGEYF | 1929 | WGKGT LVTVSS | 2211 |
| LG213D6 | 1366 | RFTISRDNA KNMLYLQM NSLKPEDTA VYLCAQ | 1648 | GLMAEV TAGY | 1930 | WGQGT QVTVSS | 2212 |
| LG213D7 | 1367 | RFTVSRDNA KNTVYLQMN SLKPEDTAV YYCNV | 1649 | VSYGEYF | 1931 | WGKGT LVTVSS | 2213 |
| LG213E6 | 1368 | RFTISRDNA KNTGYLQM NSLKPDDTA VYYCAA | 1650 | DSSVVP GIEKYDD | 1932 | WGLGT QVTVSS | 2214 |
| LG213H7 | 1369 | RFIFSEDNA KNTVYLQMN SLKPEDTAV YYCAA | 1651 | ALIGGY YSDVDA WSY | 1933 | WGPGT QVTVSS | 2215 |
| LG214A8 | 1370 | RFAITRDAA KNTVHLQMN SLKPEDTAV YYCAA | 1652 | ATYGYG SYTYGG SYDL | 1934 | WGQGT QVTVSS | 2216 |
| LG214C10 | 1371 | RFTISRDNA KNTLYLQMN SLKPEDTAV YYCST | 1653 | NLYPTT DDV | 1935 | WGQGT QVTVSS | 2217 |
| LG214D10 | 1372 | RFTVSRDSA KITVFLQMD NLKPEDTAV YYCAA | 1654 | DKGVYT TVSRSM ADYGA | 1936 | WGQGT QVTVSS | 2218 |
| LG214E8 | 1373 | RFAITRDAA KNTVHLQMN SLKPEDTAV YYCAA | 1655 | ATYGYG SYTYGG SYDL | 1937 | WGQGT QVTVSS | 2219 |
| LG214F8 | 1374 | RFTISRDTAK NTVYLQMNS LKPEDTAVY YCNA | 1656 | EVIYYPY DY | 1938 | WGQGT QVTVSS | 2220 |
| LG214H10 | 1375 | RFAITRDAA KNTVHLQMN SLKPEDTAV YYCAA | 1657 | ATYGYG SYTYGG SYDL | 1939 | WGQGT QVTVSS | 2221 |
| RSVPMP5C1 | 1376 | RFTISRDNA KNTVYLQID SLQPEDTAV YYCAA | 1658 | RQDYGL GYRDLH EYDY | 1940 | WGQGT QVTVSS | 2222 |
| RSVPMP8A1 | 1377 | RFTISRDNA KNTVYLRIDS LNPEDTAVY YCAA | 1659 | RQDYGL GYRESH EYDY | 1941 | WGQGT QVTVSS | 2223 |
| RSVPMP8G1 | 1378 | RFTISRDNA KNTVYLRIDS LNPEDTAVY YCAA | 1660 | RQDYGL GYRESH EYDY | 1942 | WGQGT QVTVSS | 2224 |
| RSVPMP25B3 | 1379 | RFTISRDNA KNTVYLRIDS LNPEDTAVY YCAA | 1661 | RQDYGL GYRESH EYDY | 1943 | WGQGT QVTVSS | 2225 |

TABLE B-1-continued

Preferred combinations of CDR sequences, preferred combinations of framework sequences, and preferred combinations of framework and CDR sequences.

| | | | | | | | |
|---|---|---|---|---|---|---|---|
| RSVPMP8C8 | 1380 | RFTISRDNA KNTLYLQMN SLEPEDTAV YYCAA | 1662 | SKEWDI SASGDD YDY | 1944 | WGQGT QVTVSS | 2226 |
| RSVPMP5A6 | 1381 | RFTISRDNA KNTLYLQMN DLKSEDTAV YYCSK | 1663 | DGIYSS | 1945 | KGQGT QVTVSS | 2227 |
| RSVPMP8E11 | 1382 | RFTISRDNA KNTLYLQMN DLKSEDTAV YYCSK | 1664 | DGIYSS | 1946 | KGQGT QVTVSS | 2228 |
| RSVPMP8F11 | 1383 | RFTISRDNA KNTLYLQMN DLKSEDTAV YYCSK | 1665 | DGIHSS | 1947 | KGQGT QVTVSS | 2229 |
| RSVPMP13F11 | 1384 | RFTISRDNA KNTLYLQMN DLKSEDTAV YYCSK | 1666 | DGIYSS | 1948 | KGQGT QVTVSS | 2230 |
| RSVPMP15B8 | 1385 | RFTISRDNA KNTLYLQMN DLKSEDTAV YYCSK | 1667 | DGIYSS | 1949 | KGQGT QVTVSS | 2231 |
| RSVPMP15G11 | 1386 | RFTISRDNA KNTLYLQMN DLKSEDTAV YYCSK | 1668 | DGIYSS | 1950 | KGQGT QVTVSS | 2232 |
| RSVPMP17C10 | 1387 | RFTISRDNA KNTLYLQMN DLKSEDTAV YYCSK | 1669 | DGIYSS | 1951 | KGQGT QVTVSS | 2233 |
| RSVPMP21E7 | 1388 | RFIISRDNAK NTLYLQMND LKSEDTAVY YCSK | 1670 | DGIYSS | 1952 | KGQGT QVTVSS | 2234 |
| RSVPMP21F8 | 1389 | RFTISRDNA KNTLYLQMN DLKSEDTAV YYCSK | 1671 | DGIHSS | 1953 | KGRGT QVTVSS | 2235 |
| RSVPMP5A2 | 1390 | RFTISRDNA KNTVYLQMN SLKPEDTAV YYCAT | 1672 | DPALGC YSGTYY PRYDY | 1954 | WGQGT QVTVSS | 2236 |
| RSVPMP5B2 | 1391 | RFTISWDNA KNTVYLQMN SLKPEDTAV YYCAA | 1673 | DPALGC YSGSYY PRYDY | 1955 | WGQGT QVTVSS | 2237 |
| RSVPMP5C3 | 1392 | RFTISRDNA KNTVYLQMN SLKPEDTAV YYCAV | 1674 | DPALGC YSGSYY PRYDY | 1956 | WGQGT QVTVSS | 2238 |
| RSVPMP5D2 | 1393 | RFTISRDNA KNTVYLQMN SLKPEDTAV YYCAV | 1675 | DPALGC YSGSYY PRYDY | 1957 | WGQGT QVTVSS | 2239 |
| RSVPMP5E2 | 1394 | RFTISWDNA KNTVYLQMN SLKPEDTAV YYCAA | 1676 | DPALGC YSGSYY PRYDY | 1958 | YGQGT QVTVSS | 2240 |

TABLE B-1-continued

Preferred combinations of CDR sequences, preferred combinations of framework sequences, and preferred combinations of framework and CDR sequences.

| | | | | | | | | |
|---|---|---|---|---|---|---|---|---|
| RSVPMP5F3 | 1395 | RFTISWDNA KNTLYLQMN SLKPEDTAV YYCAA | 1677 | DPALGC YSGSYY PRYDY | 1959 | WGQGT QVTVSS | 2241 |
| RSVPMP5G3 | 1396 | RFTISRDNA KNTVYLQMN SLKPEDTAV YYCAT | 1678 | DPALGC YSGSYY PRYDY | 1960 | WGQGT QVTVSS | 2242 |
| RSVPMP5H2 | 1397 | RFTISWDSA KNTVYLQMN DLKPEDTAV YYCAA | 1679 | DPALGC YSGSYY PRYDY | 1961 | WGQGT QVTVSS | 2243 |
| RSVPMP5H3 | 1398 | RFTISRDNA KNTVYLQMN SLQPEDTAV YYCAA | 1680 | DPALGC YSGSYY PRYDY | 1962 | WGQGT QVTVSS | 2244 |
| RSVPMP8C1 | 1399 | RFTISRDNA KNTVYLQMN SLKPEDTAV YYCAA | 1681 | DPALGC YSGSYY PRYDY | 1963 | WGQGT QVTVSS | 2245 |
| RSVPMP8F2 | 1400 | RFTISRDNA KNTVYLQMN SLTPEDTAV YYCAV | 1682 | DPALGC YSGSYY PRYDY | 1964 | WGQGT QVTVSS | 2246 |
| RSVPMP8G4 | 1401 | RFTISRDNA KNTVYLQMN GLKPEDTAV YYCAT | 1683 | DPALGC YSGSYY PRYDY | 1965 | WGQGT QVTVSS | 2247 |
| RSVPMP13A1 | 1402 | RFTISWDNA KNTVYLQMN SLKPEDTAV YYCAA | 1684 | DPALGC YSGNYY PRYDY | 1966 | WGQGT QVTVSS | 2248 |
| RSVPMP13A4 | 1403 | RFTISWDNA KNTVYLQMN SLKPEDTAV YYCAA | 1685 | DPALGC YSGSYY PRYDY | 1967 | WGQGT QVTVSS | 2249 |
| RSVPMP13B1 | 1404 | RFTISRDNA KNTVYLQMN SLTPEDTAV YYCAA | 1686 | DPALGC YSGNYY PRYDY | 1968 | WGQGT QVTVSS | 2250 |
| RSVPMP13B2 | 1405 | RFTISRDNA KNTVYLQMN SLKPEDTAV YYCAT | 1687 | DPALGC YSGSYY PRYDY | 1969 | WGQGT QVTVSS | 2251 |
| RSVPMP13C1 | 1406 | RFTISRDNA KNTVYLQMN SLEPEDTAV YYCAT | 1688 | DPALGC YSGSYY PRYDY | 1970 | WGQGT QVTVSS | 2252 |
| RSVPMP13C3 | 1407 | RFTISWDNA KNMVYLQM NSLKPEDTA VYYCAA | 1689 | DPALGC YSGNYY PRYDY | 1971 | WGQGT QVTVSS | 2253 |
| RSVPMP13D6 | 1408 | RFTISWDNA KNTVYLQMN SLKPEDTAV YYCAA | 1690 | DPALGC YSGSYY PRYDY | 1972 | WGQGT QVTVSS | 2254 |
| RSVPMP13E2 | 1409 | RFTISWDNA KKMVYLQM NKLKPEDTA VYYCAA | 1691 | DPALGC YSGSYY PRYDY | 1973 | WGQGT QVTVSS | 2255 |

TABLE B-1-continued

Preferred combinations of CDR sequences, preferred combinations of framework sequences, and preferred combinations of framework and CDR sequences.

| | | | | | | | |
|---|---|---|---|---|---|---|---|
| RSVPMP13E3 | 1410 | RFTISWDNA KNTLYLQMN SLKPEDTAV YYCAA | 1692 | DPALGC YSGSYY PRYDF | 1974 | WGQGT QVTVSS | 2256 |
| RSVPMP15A5 | 1411 | RFTISRDNT KNTVYLQMN SLTPEDTAIY YCAV | 1693 | DPALGC YSGNYY PRYDY | 1975 | WGQGT QVTVSS | 2257 |
| RSVPMP15A6 | 1412 | RFTISWDNA KNTVYLQMS SLKPEDTAV YHCAA | 1694 | DPALGC YSGSYY PRYDY | 1976 | WGQGT QVTVSS | 2258 |
| RSVPMP15B2 | 1413 | RFTISRDNA KNMVYLQM NSLKPEDTA VYYCAT | 1695 | DPALGC YSGSYY PRYDY | 1977 | WGQGT QVTVSS | 2259 |
| RSVPMP15B3 | 1414 | RFTISWDNA KNTLYLQMN SLKPGDTAV YYCAA | 1696 | DPALGC YSGSYY PRYDY | 1978 | WGQGT QVTVSS | 2260 |
| RSVPMP15E5 | 1415 | RFTISRDNA KNTVYLQMN NLTPEDTAV YYCAT | 1697 | DPALGC YSGNYY PRYDY | 1979 | WGQGT QVTVSS | 2261 |
| RSVPMP17C2 | 1416 | RFTISRDNA RNTVYLQMN NLTPEDTAV YYCAT | 1698 | DPALGC YSGNYY PRYDY | 1980 | WGQGT QVTVSS | 2262 |
| RSVPMP17D4 | 1417 | RFTISWDNA KNIVYLQMN SLKPEDTAV YYCAA | 1699 | DPALGC YSGSYY PRYDY | 1981 | WGQGT QVTVSS | 2263 |
| RSVPMP17G4 | 1418 | RFTISWDSA KNTVYLQMN DLKPEDTAV YYCAA | 1700 | DPALGC YSGSYY PRYDY | 1982 | WGQGT QVTVSS | 2264 |
| RSVPMP19B2 | 1419 | RFTISWDNA KKVVYLQMN SLKPEDTAV YYCAA | 1701 | DPALGC YSGSYY PRYDY | 1983 | WGQGT QVTVSS | 2265 |
| RSVPMP25A4 | 1420 | RFTISWDNA KNMVYLQM NSLKPEDTA VYYCAA | 1702 | DPALGC YSGSYY PRYDY | 1984 | WGQGT QVTVSS | 2266 |
| RSVPMP25A9 | 1421 | RFTISRDNA KNTVYLQMN GLKPEDTAV YYCAT | 1703 | DPALGC YSGSYY PRYDY | 1985 | WGQGT QVTVSS | 2267 |
| RSVPMP25B5 | 1422 | RFTISWDNA KNTLYLQMN SLKPEDTAV YYCAA | 1704 | DPALGC YSGSYY PRYDY | 1986 | WGQGT QVTVSS | 2268 |
| RSVPMP25G2 | 1423 | FTISWDNAK NMVYLQMN SLKPEDTAV YYCAA | 1705 | DPALGC YSGSYY PRYDY | 1987 | WGQGT QVTVSS | 2269 |
| RSVPMP25H5 | 1424 | RFTISWDNA KNTVYLQMN SLKPEDTAV YYCAA | 1706 | DPALGC YSGSYY PRYDY | 1988 | WGQGT QVTVSS | 2270 |

TABLE B-1-continued

Preferred combinations of CDR sequences, preferred combinations of framework sequences, and preferred combinations of framework and CDR sequences.

| | | | | | | | | |
|---|---|---|---|---|---|---|---|---|
| RSVPMP25E11 | 1425 | RFTISRDNT KNTVYLQMN SLTPEDTAV YYCAV | 1707 | DPALGC YSGNYY PRYDY | 1989 | WGQGT QVTVSS | 2271 |
| RSVPMP8G3 | 1426 | RFTISWDNA KNTLYLQMN SLKPEDTAV YYCAA | 1708 | DPALGC YSGSYY PRYDF | 1990 | WGQGT QVTVSS | 2272 |
| RSVPMP13B5 | 1427 | RFTISWDNA KNTLYLQMN SLKPEDTAV YYCAA | 1709 | DPALGC YSGNYY PRYDF | 1991 | WGQGT QVTVSS | 2273 |
| RSVPMP15F2 | 1428 | RFTISWDNA KNTLYLQMN SLKPEDTAV YYCAA | 1710 | DPALGC YSGNYY PRYDF | 1992 | WGQGT QVTVSS | 2274 |
| RSVPMP19E2 | 1429 | RFTISWDNA KNTLYLQMN SLKPEDTAV YYCAA | 1711 | DPALGC YSGSYY PRYDF | 1993 | WGQGT QVTVSS | 2275 |
| RSVPMP25D1 | 1430 | RFTISWDNA KNTLYLQMT SLKPEDTAV YYCAA | 1712 | DPALGC YSGSYY PRYDF | 1994 | WGQGT QVTVSS | 2276 |
| RSVPMP5A1 | 1431 | RFTISRDNA KNMVYLQM TSLKPEDTA VYYCAA | 1713 | DFALGC YSGSYV PRYDY | 1995 | WGQGT QVTVSS | 2277 |
| RSVPMP5G2 | 1432 | RFTISRDNA KNMVYLQM TSLKPEDTA VYYCAA | 1714 | DFALGC YSGSYY PRYDY | 1996 | WGQGT QVTVSS | 2278 |
| RSVPMP5H1 | 1433 | RFTISRDTAK NMVYLQMT SLKPEDTAV YYCAA | 1715 | DFALGC YSGSYY PRYDY | 1997 | WGQGT QVTVSS | 2279 |
| RSVPMP6B1 | 1434 | RFTISRDNA KNMVYLQM TSLKPEDTA VYYCAA | 1716 | DFALGC YSGSYY PRYDY | 1998 | WGQGT QVTVSS | 2280 |
| RSVPMP8H2 | 1435 | RFTISTDNAK NMVYLQMT SLKPEDTAV YYCAA | 1717 | DFALGC YSGSYY PRYDY | 1999 | WGQGT QVTVSS | 2281 |
| RSVPMP8H3 | 1436 | RFTISRDNA KNMVYLQM TSLKPEDTA VYYCAA | 1718 | DFALGC YSGSYY PRYDY | 2000 | WGQGT QVTVSS | 2282 |
| RSVPMP13A3 | 1437 | RFTISRDTAK NMVYLQMT SLKPEDTAV YYCAA | 1719 | DFALGC YSGSYY PRYDY | 2001 | WGQGT QVTVSS | 2283 |
| RSVPMP13C5 | 1438 | RFTISRDNA KNMVYLQM TSLMPEDTA VYYCAA | 1720 | DFALGC YSGSYY PRYDY | 2002 | WGQGT QVTVSS | 2284 |
| RSVPMP13H1 | 1439 | RFTISRDNA KNMVYLQM TSLKPEDTA VYYCAA | 1721 | DFALGC YSGSYY PRYDY | 2003 | WGQGT QVTVSS | 2285 |

TABLE B-1-continued

Preferred combinations of CDR sequences, preferred combinations of framework sequences, and preferred combinations of framework and CDR sequences.

| | | | | | | | |
|---|---|---|---|---|---|---|---|
| RSVPMP13H2 | 1440 | RFTISRDNA KNMVYLQM TSLKPEDTAI YYCAA | 1722 | DFALGC YSGSYY PRYDY | 2004 | WGQGT QVTVSS | 2286 |
| RSVPMP15E6 | 1441 | RFTISRDNA KNMVYLQM TSLKPEDTA VYYCAA | 1723 | DFALGC YSGSYY PRYDY | 2005 | WGQGT QVTVSS | 2287 |
| RSVPMP17A3 | 1442 | RFTISRDNA KNMVYLQM TSLKPEDTA VYYCAA | 1724 | DFALGC YSGSYV PRYDY | 2006 | WGQGT QVTVSS | 2288 |
| RSVPMP25G8 | 1443 | RFTISRDNA KNMVYLQM TSLKPEDTA VYYCAA | 1725 | DFPLGC YSGSYV PRYDY | 2007 | WGQGT QVTVSS | 2289 |
| RSVPMP6D1 | 1444 | RFTISSDNA KNTVYLTMN NLKPEDTAV YYCAA | 1726 | DRLSTV VGCLYY GGSYYP RTTIDY | 2008 | WGKGT LVTVSS | 2290 |
| RSVPMP8D5 | 1445 | RFTISSDNA KNTVYLTMN SLKPEDTAV YYCAA | 1727 | DLLSTV VGCLYY RGSYYP RTTADY | 2009 | WGKGT LVTVSS | 2291 |
| RSVPMP13B4 | 1446 | RFTISSDNA KNMVYLQM NSLKPEDTA VYYCAA | 1728 | DLLRTA VGCLDY RGTYYP RTTMDY | 2010 | RGKGT LVTVSS | 2292 |
| RSVPMP13B6 | 1447 | RFTISSDNA KNTVYLTMN SLKPEDTAV YYCAA | 1729 | DLLSTV VGCLYY RGSYYP RTTADY | 2011 | WGKGT LVTVSS | 2293 |
| RSVPMP13E6 | 1448 | RFTISSDNA KNTVYLQMN SLKPEDTAV YYCAA | 1730 | DLLRTA VGCLYY RGTYYP RTTMDY | 2012 | RGKGT LVTVSS | 2294 |
| RSVPMP13F4 | 1449 | RFTISSDNA KNTVYLTMN SLKPEDTAV YYCAA | 1731 | DQLSTV VGCFYY RGSYYP RTTADY | 2013 | WGKGT LVTVSS | 2295 |
| RSVPMP15H3 | 1450 | RFTISRDNA KNTVYLQMN SLKPEDTAV YYCAA | 1732 | DLLATA VGCLYY RGTYYP RTTMDY | 2014 | WGKGT LVTVSS | 2296 |
| RSVPMP17E5 | 1451 | RFTISSDNA KNTVYLAMN NLKPGDTAV YYCAA | 1733 | DLLSTV VGCLYY GGSYYP RTTIDY | 2015 | WGKGT LVTVSS | 2297 |
| RSVPMP19D3 | 1452 | RFTISSDNA KNTVYLQMN SLKPEDTAV YYCAA | 1734 | DLLRTV VGCLYY GGRYSP RTTTDY | 2016 | WGKGT LVTVSS | 2298 |
| RSVPMP19F3 | 1453 | RFTISSDNA KNTVYLTMN NLKPEDTAV YYCAA | 1735 | DLLSTV VGCLYY GGSYYP RTTIDY | 2017 | WGKGT LVTVSS | 2299 |
| RSVPMP25C4 | 1454 | RFTISSDNA KNTVYLQMN SLKPEDTAV YYCAA | 1736 | DLLRTA VGCLHY RGSYYP RTTIDY | 2018 | WGKGT LVTVSS | 2300 |

TABLE B-1-continued

Preferred combinations of CDR sequences, preferred combinations of framework sequences, and preferred combinations of framework and CDR sequences.

| | | | | | | | | |
|---|---|---|---|---|---|---|---|---|
| RSVPMP25E3 | 1455 | RFTISKDNAKNTVYLQMNSLKPEDTAVYYCAA | 1737 | DLLRTVVGCLYYGGSYSPRTTMDY | 2019 | WGKGTLVTVSS | 2301 |
| RSVPMP5G4 | 1456 | RITIFRDNAKNTAYLQMNSLNPEDTAVYYCAA | 1738 | APTLVEITTTPTY | 2020 | WGQGTQVTVSS | 2302 |
| RSVPMP6G5 | 1457 | RITIFRDNAKNTVYLQMNSLNPEDTAVYYCAA | 1739 | APTLVEITPTPTY | 2021 | WGQGTQVTVSS | 2303 |
| RSVPMP8E6 | 1458 | RITIFRDNAKNTVYLQMNSLNPEDTAVYYCAA | 1740 | APTLVEITPTPTY | 2022 | WGQGTQVTVSS | 2304 |
| RSVPMP13A10 | 1459 | RITIFRDNAKNTAYLQMNSLNPEDTAVYYCAA | 1741 | APTLVEITTTPTY | 2023 | WGQGTQVTVSS | 2305 |
| RSVPMP21H10 | 1460 | RITIFRDNAKNTVYLQMNSLNPEDTAVYYCAA | 1742 | APTLVEITPTPTY | 2024 | WGRGTRVTVSS | 2306 |
| RSVPMP5A8 | 1461 | RFTISRDNAKNTVYLQMNSLKPEDTAAYYCAT | 1743 | TDDYINTTPALYRN | 2025 | WGQGTQVTVSS | 2307 |
| RSVPMP5A10 | 1462 | RFTISRDNAKNTVYLQMNSLRPEDTAVYYCAA | 1744 | DSNVNTVKLGWGRY | 2026 | WGQGTQVTVSS | 2308 |
| RSVPMP14A6 | 1463 | RFTISRDNAKNTVYLQMNSLRPEDTAVYYCAA | 1745 | DSSVNTVKLGWGRY | 2027 | WGQGTQVTVSS | 2309 |
| RSVPMP16A6 | 1464 | RFTISRDNAKNTVYLQMNSLRPEDTAVYYCAA | 1746 | DSNVNTVKLGWGRY | 2028 | WGQGTQVTVSS | 2310 |
| RSVPMP22D6 | 1465 | RFTISRDNAKNTVYLQMNSLRPEDTAVYYCAA | 1747 | DSNVNTVKLGWGRY | 2029 | WGQGTQVTVSS | 2311 |
| RSVPMP8E2 | 1466 | RFTISRDNAKNTVYLQMNSLKPEDTAVYYCNA | 1748 | DVRVAEKHTAYEANY | 2030 | WGQGTQVTVSS | 2312 |
| RSVPMP8C6 | 1467 | RFTISRDNAKNTVYLQMNSLKPEDTAVYYCYL | 1749 | KMYGGNWYTY | 2031 | WGQGTQVTVSS | 2313 |
| RSVPMP5C6 | 1468 | FTMSRDNAKSSVYLQMINLKPEDTAVYYCAA | 1750 | ATSPLFVASDYFDASRYDY | 2032 | WGQGTQVTVSS | 2314 |
| RSVPMP6D4 | 1469 | SISRDNAKSAVYLQMNNLKPEDTAVYYCAA | 1751 | AASTLFIASDYFEASRYDY | 2033 | WGQGTQVTVSS | 2315 |

TABLE B-1-continued

Preferred combinations of CDR sequences, preferred combinations of framework sequences, and preferred combinations of framework and CDR sequences.

| | | | | | | | |
|---|---|---|---|---|---|---|---|
| RSVPMP8B10 | 1470 | FTMSRDNAKSSVYLQMINLKPEDTAVYYCAA | 1752 | TSPLFVASDYFEASRYGY | 2034 | WGQGTQVTVSS | 2316 |
| RSVPMP8E10 | 1471 | FTMSRDNAKSSVYLQMINLKPEDTAVYYCAA | 1753 | ASPLFVASDYFEASRYGY | 2035 | WGQGTQVTVSS | 2317 |
| RSVPMP15A7 | 1472 | SISRDNAKSAVYLQMNNLKPEDTAVYYCAA | 1754 | AASTLFVASDYFEASRYDY | 2036 | WGQGTQVTVSS | 2318 |
| RSVPMP15E10 | 1473 | FTMSRDNAKSSVYLQMINLEPEDTAVYYCAA | 1755 | TSPLFVASDYFEASRYGY | 2037 | WGQGTQVTVSS | 2319 |
| RSVPMP13C7 | 1474 | RITISRDNAKNTVYLQMNSLKPEDTAIYYCAA | 1756 | DNTAYGSFKADDYDY | 2038 | WGQGTQVTVSS | 2320 |
| RSVPMP15A9 | 1475 | RITISRDNAKNTVYLQMNSLTPEDTAIYYCAA | 1757 | DSTAYGSFKADDYDY | 2039 | WGQGTQVTVSS | 2321 |
| RSVPMP15F11 | 1476 | RITISRDNAKNTVYLQMNSLKPEDTAIYYCAA | 1758 | DSTAYGSFKADDYDY | 2040 | WGQGTQVTVSS | 2322 |
| RSVPMP15A1 | 1477 | RFTISRDNAKNTVYLQMNSLKPEDTAVYYCAT | 1759 | DLTDSLCSYYDYMRPENDY | 2041 | WGQGTQVTVSS | 2323 |
| RSVPMP6H2 | 1478 | RFTISRDNAKNTVYLQMNSLKPEDTAVYYCAT | 1760 | DLTDSLCSYYHYMRPENDY | 2042 | WGQGTQVTVSS | 2324 |
| RSVPMP17A9 | 1479 | RFTMSRDNAKNTLYLQMNSLEPEDTAVYSCAA | 1761 | NSDTYYIYSDIVVPERYDY | 2043 | WGQGTQVTVSS | 2325 |
| RSVPMP7G1 | 1480 | RFTISRDNAKNTVYLQMNSLKPDDTAVYYCAT | 1762 | GSEPYYTNTYDY | 2044 | WGQGTQVTVSS | 2326 |
| RSVPMP5A9 | 1481 | RFTISRDNAKNTVYLQMNSLKPEDTAVYYCAA | 1763 | DISSGNSGSYIYTWAYDY | 2045 | WGQGTQVTVSS | 2327 |
| RSVPMP7B2 | 1482 | RFTISRDNAKNTVYLQMNSLKPEDTAVYYCAA | 1764 | DLTSTNPGSYIYIWAYDY | 2046 | WGQGTQVTVSS | 2328 |
| RSVPMP22A4 | 1483 | RFTISRDNAKNTVYLQMSSLKPEDTAVYYCAA | 1765 | DISSGNSGSYIYTWAYDY | 2047 | WGQGTQVTVSS | 2329 |
| RSVPMP22E10 | 1484 | RFTISRDNAKNTVYLQMNSLKPEDTAVYYCAA | 1766 | DISSGNSGSYIYTWAYDY | 2048 | WGQGTQVTVSS | 2330 |

TABLE B-1-continued

| Preferred combinations of CDR sequences, preferred combinations of framework sequences, and preferred combinations of framework and CDR sequences. | | | | | | | |
|---|---|---|---|---|---|---|---|
| RSVPMP22H4 | 1485 | RFTISRDNA KNTVYLQMN SLKPEDTAV YYCAA | 1767 | DISSGN SGSYIYT WAYDY | 2049 | WGQGT QVTVSS | 2331 |
| RSVPMP15C5 | 1486 | RFIISRDNAK NTVYLLMNS LQSDDTAVY YCVA | 1768 | DGVLAT TLNWDY | 2050 | WGQGT QVTVSS | 2332 |
| RSVNC39 | 1487 | RFIISRDNAK NTVHLLMNS LQSDDTAVY YCVA | 1769 | DGVLAT TLNWDY | 2051 | WGQGT QVTVSS | 2333 |
| RSVPMP7B9 | 1488 | RLTVSRDNA KNTAYLQMN SLKPEDTAV YYCAA | 1770 | ALLGEN LQWKG AYDY | 2052 | WGQGT QVTVSS | 2334 |
| RSVPMP15E11 | 1489 | RFTISRDNA KNTVYLQMN SLESEDTAV YYCAA | 1771 | DYSHTF VYPSMV PYESDY | 2053 | WGQGT QVTVSS | 2335 |
| RSVPMP7E7 | 1490 | RFTISRDNA KNTLYLQMN SLKPEDTGV YYCAK | 1772 | GMSPNI EYAQGP VAY | 2054 | RGQGT QVTVSS | 2336 |
| RSVPMP14H3 | 1491 | RFTISRDNA KNTGYLQM NSLKPEDTA VYYCAL | 1773 | DHKASG SYSSLS RPEEYDY | 2055 | WGQGT QVTVSS | 2337 |
| RSVPMP24D6 | 1492 | RFTMFSDNA KNTVALQMN SLKPEDTAV YYCTV | 1774 | LFGTSS CTYYSR RKYEYDY | 2056 | WGQGT QVTVSS | 2338 |
| RSVPMP23E5 | 1493 | RFTISRDNA KNTVHLQMN SLKPEDTAV YYCAA | 1775 | AHNTMG SDYEGY DY | 2057 | WGQGT QVTVSS | 2339 |
| RSVPMP8A6 | 1494 | RFTISSDNA KNTVYLQMN SLKPEDTAV YYCAA | 1776 | SRRGGS RWYGLS GSCYYG MDY | 2058 | WGKGT LVTVSS | 2340 |
| RSVPMP14E2 | 1495 | RFTISRDNA KNTLYLQMN SLKPEDTAV YYCAK | 1777 | DPYGSS WYGSP VYDY | 2059 | WGQGT QVTVSS | 2341 |
| RSVPMP25F3 | 1496 | RFTISSDNA KNTVYLQMN SLKPEDTAV YYCAA | 1778 | GRSLYA KGSWW LISSEYDY | 2060 | WGQGT QVTVSS | 2342 |
| RSVPMP19A6 | 1497 | RFTVSRDNA QNTVYLQM NSLKPDDTA VYYCYV | 1779 | RWYSS MWYEY | 2061 | WGQGT QVTVSS | 2343 |
| RSVPMP23G1 | 1498 | RFTLSRDNA KNTVYLQMN SLKPEDTAV YYCAA | 1780 | PISSYV GGNYYS AAFYHY | 2062 | WGQGT QVTVSS | 2344 |
| RSVPMP15H8 | 1499 | RFTISRDNA KNTGYLQM NSLVPDDTA VYYCGA | 1781 | GTPLNP GAYIYD WSYDY | 2063 | WGRGT QVTVSS | 2345 |

TABLE B-1-continued

Preferred combinations of CDR sequences, preferred combinations of framework sequences, and preferred combinations of framework and CDR sequences.

| | | | | | | | | |
|---|---|---|---|---|---|---|---|---|
| RSVNC41 | 1500 | RFTISKDNA KNTGYLQM NSLAPDDTA VYYCGA | 1782 | DTPLNP GAYIYD WSYDY | 2064 | WGRGT QVTVSS | 2346 |
| RSVPMP6A8 | 1501 | RFTISRDNA KNTVYLQMN SLKPEDTAV YYCAA | 1783 | DHSRVY YRDYRQ GRLCEE PYDY | 2065 | WGQGT QVTVSS | 2347 |
| RSVPMP25H9 | 1502 | RFTISRDNA KNAVYLQMN SLKPEDSAV YYCAF | 1784 | DARPAP YITNYKD PRAYDY | 2066 | WGQGT QVTVSS | 2348 |
| RSVPMP8B11 | 1503 | RFTVSRDNA KNMVYLQM NSLKPEDTA VYYCAA | 1785 | GFQYYS TITNYAR ERDYDY | 2067 | WGQGT QVTVSS | 2349 |
| RSVPMP17E1 | 1504 | RFTISRDNA KETVSLQMS GLKPEDTAV YYCAA | 1786 | DQPPST WLVEYF DY | 2068 | WGQGT RVTVSS | 2350 |
| RSVPMP21A4 | 1505 | RFTISRDNA KEIVSLQMS GLKPEDTAV YYCAA | 1787 | DQPPST WLAEYF DY | 2069 | WGQGT RVTVSS | 2351 |
| RSVPMP25A11 | 1506 | RFTISRDNA KETVSLQMS GLKPEDTAV YYCAA | 1788 | DQPPST WLVEYF DY | 2070 | WGQGT RVTVSS | 2352 |
| RSVPMP25C8 | 1507 | RFTISRDNA KETVSLQMN GLKPEDTAV YYCAA | 1789 | DQPPST WLVEYF DY | 2071 | WGQGT QVTVSS | 2353 |
| RSVNC23 | 1508 | RFIISRDDAA NTAYLQMNS LKPEDTAVY YCAV | 1790 | DTASWN SGSFIY DWAYDH | 2072 | WGQGT QVTVSS | 2354 |
| RSVPMP20A11 | 1509 | RFTISRDNA KNTVYLQMN SLGPEDTAIY TCAA | 1791 | KENGMF ITATQE QSYDY | 2073 | WGQGT QVTVSS | 2355 |
| RSVPMP20A9 | 1510 | RFTISEDNA NNTVYLQMH SVKPEDTAT YYCAA | 1792 | DTQFSG YVPKET NEYDY | 2074 | WGQGT QVTVSS | 2356 |
| RSVPMP1F7 | 1511 | RFAISRDNA KSTVYLQMN SLKPEDTAV YYCAI | 1793 | DYTSSC PIYSGT DY | 2075 | WGKGT LVTVSS | 2357 |
| RSVPMP20D6 | 1512 | RFTISSDNA KNTVYLQMN SLKPEDTAV YYCAA | 1794 | DFSLAQ YKTIHT MPPYAM DY | 2076 | WGKGT LVTVSS | 2358 |
| RSVPMP1F1 | 1513 | RFTMSSDNA KNTVDLQMN SLKPEDTAL YYCAG | 1795 | SSRIYVY SDSLSE GSYDY | 2077 | WGRGT QVTVSS | 2359 |
| RSVPMP3D3 | 1514 | RFTISRDDA QNAVYLQM NSLKPEDTA VYYCAA | 1796 | NPSYVY SDYLSL AGYTY | 2078 | WGQGT QVTVSS | 2360 |

TABLE B-1-continued

Preferred combinations of CDR sequences, preferred combinations of framework sequences, and preferred combinations of framework and CDR sequences.

| | | | | | | | |
|---|---|---|---|---|---|---|---|
| RSVPMP3E6 | 1515 | RFTISRDNAKNTLYLQMSSLKPEDTALYYCAR | 1797 | NRDSGTSYITFSLTDFAS | 2079 | WGQGTQVTVSS | 2361 |
| RSVPMP1C8 | 1516 | RFTISRDNAKNTVYLQMNSLKPEDTADYLCAA | 1798 | RKYYIHSDVVGNDYPY | 2080 | WGQGTQVTVSS | 2362 |
| RSVPMP1A2 | 1517 | RFTISRDNANNAVYLQMNSLQPEDTAIYYCAA | 1799 | DSLGGFRSASDYYNTNTYAY | 2081 | WGQGTQVTVSS | 2363 |
| RSVPMP1C5 | 1518 | RFTISRDNAKNTVYLQMNSLKPEDAAVYYCAA | 1800 | DPSDWTCNVLEYDY | 2082 | WGQGTQVTVSS | 2364 |
| RSVPMP20G5 | 1519 | RFTISRDNAKNTVYLQMNSLKPEDTAVYYCNV | 1801 | HNY | 2083 | WGQGTQVTVSS | 2365 |
| RSVPMP4D8 | 1520 | RFTISRDNAKNTMYLQMNSLKPEDTAVYYCAA | 1802 | GSGILNSGSYYYPWVYEY | 2084 | WGQGTQVTVSS | 2366 |
| RSVPMP20B6 | 1521 | RFTISRDNAKNTVYLQMNSLKPEDTAVYICNA | 1803 | EGLIIATMDGGVNNDMDY | 2085 | WGKGTLVTVSS | 2367 |
| RSVPMP1D11 | 1522 | RFTSSRDNAKNTAYLQMNSLGPEDTAVYYCNF | 1804 | RDYEGNH | 2086 | WGQGTQVTVSS | 2368 |
| RSVPMP20A8 | 1523 | RFTIARDNAKNTVYLQANNMKPEDTAVYYCAA | 1805 | ALLLLPTTPSRVDY | 2087 | WGQGTQVTVSS | 2369 |
| RSVPMP20E7 | 1524 | RFTIARDNAKNTVYLQANNMKPEDTAVYYCAA | 1806 | ALLLLPTTPSRVDY | 2088 | WGQGTQVTVSS | 2370 |
| RSVPMP20G8 | 1525 | RFTITRDNAKNTVYLQANNMKPEDTAVYYCAA | 1807 | ALLLLPTTPSRVDY | 2089 | WGQGTQVTVSS | 2371 |
| RSVPMP2D3 | 1526 | RFTIARDNAKNTVYLQADNMKPEDTAVYYCAA | 1808 | ALLLLPTSPSRVDY | 2090 | WGQGTQVTVSS | 2372 |
| RSVPMP2G5 | 1527 | RFTIARDNAKNTVYLQANNMKPEDTAVYYCAA | 1809 | ALLLLPTTPSRVDY | 2091 | WGQGTQVTVSS | 2373 |
| RSVPMP2A6 | 1528 | RFTISRDNAKNTLYLQMNSLKAEDTAVYYCAK | 1810 | YWAPWPMDVSRLDDYDN | 2092 | KGQGTQVTVSS | 2374 |
| RSVPMP3A2 | 1529 | RFTISRDNAENTVYLQMNSLKPEDTAVYTCAA | 1811 | DSTNRNSGAIYYPWAYDY | 2093 | WGQGTQVTVSS | 2375 |

TABLE B-1-continued

Preferred combinations of CDR sequences, preferred combinations of framework sequences, and preferred combinations of framework and CDR sequences.

| | | | | | | | |
|---|---|---|---|---|---|---|---|
| RSVPMP4A8 | 1530 | RFTISRDNA ENTVHLQMN SLKPEDTAV YTCAA | 1812 | DSTNRN SGAVYY TWAYDY | 2094 | WGQGT QVTVSS | 2376 |
| RSVPMP4F9 | 1531 | RFTISRDNA ENLVYLQMN SLKPEDTAV YTCVA | 1813 | DSTNRN SGAYYY TWAYDH | 2095 | WGQGT QVTVSS | 2377 |
| RSVPMP1A6 | 1532 | RFTMSRDNA KNTVYLEMN NLKPEDTAV YYCAA | 1814 | DTDSSN SGSYLY TWAYDY | 2096 | WGQGT QVTVSS | 2378 |
| RSVPMP3C2 | 1533 | RFTISRDNA KNTVYLQMN SLKPEDTAV YNCAA | 1815 | DVSSTN SGSYIYT WAYDY | 2097 | WGQGT QVTVSS | 2379 |
| RSVPMP4H9 | 1534 | RFTISRDNA KNTVYLKMN SLKPEDTAV YYCAV | 1816 | DASSTN SGSFIYT WAYDY | 2098 | WGQGT QVTVSS | 2380 |
| RSVPMP4B10 | 1535 | RFTISRDNA ENTVYLQMN SLQPEDTAV YTCAA | 1817 | DATNRN SGAYFY TWAYDY | 2099 | WGQGT QVTVSS | 2381 |
| 203B1 | 2503 | RFTISRDNA KNTLYLQMN SLKSEDTAV YYCVK | 2521 | DWESSY AGYSP | 2539 | NSQGT QVTVSS | 2557 |
| 203B2 | 2504 | RFTISRDNA KNTLYLQMN SLKSEDTAV YYCVK | 2522 | DWASD YAGYSP | 2540 | NSQGT QVTVSS | 2558 |
| 203G1 | 2505 | RFTISRDNA KNTLYLQMN SLKSEDTAV YYCVK | 2523 | DWASTY AGYRP | 2541 | NSQGT QVTVSS | 2559 |
| 203H1 | 2506 | RFTISRDNA KKLVYLEMN SLTVEDAAV YVCAA | 2524 | KDGPLIT HYSTTS MY | 2542 | WGQGT QVTVSS | 2560 |
| 203E12 | 2507 | RFTISRDNA KNTLYLQMN SLKSEDTAV YYCTR | 2525 | DWYND PNKNEY | 2543 | KGQGT QVTVSS | 2561 |
| 203E1 | 2508 | RCTISRDNA NNTVALELN SLKPDDTAV YYCAA | 2526 | BSHTYG STYAATI DYEYDY | 2544 | WGQGT QVTVSS | 2562 |
| 203A12 | 2509 | RFTISRDNA KNTVYLQMS SLKPEDTAIY SCAV | 2527 | ASGGGS IRSARR YDY | 2545 | WGQGT QVTVSS | 2563 |
| 203A9 | 2510 | RFTISRDNA KNTVYLQMS SLKPEDTAIY SCAV | 2528 | ASGGGS IISARRY DY | 2546 | WGQGT QVTVSS | 2564 |
| 203B12 | 2511 | RFTISRDNV KNTLYLQMN SLKPEDTAV YSCEK | 2529 | YAGSM WTSERDA | 2547 | WGQGT QVTVSS | 2565 |

TABLE B-1-continued

Preferred combinations of CDR sequences, preferred combinations of framework sequences, and preferred combinations of framework and CDR sequences.

| | | | | | | | |
|---|---|---|---|---|---|---|---|
| 203D2 | 2512 | RFTISRDNA KNTGYLQM NSLKPEDTA VYYCYV | 2530 | VGNFTTY | 2548 | WGRGT QVTVSS | 2566 |
| 203D9 | 2513 | RFTISRDNA KNTVYLQMN SLKPEDTAV YYCAA | 2531 | BQNTYG YMDRSD YEYDY | 2549 | WGQGT QVTVSS | 2567 |
| 203G3 | 2514 | RFTISRDNA KNTLYLQMN SLKSEDTAV YYCVK | 2532 | DWASD YAGYSP | 2550 | NSQGT QVTVSS | 2568 |
| 203G9 | 2515 | RFTISRDNA KNTLYLQMN SLKPEDTAL YYCRR | 2533 | SLTFTD TPDL | 2551 | RSQGT QVTVSS | 2569 |
| 203G10 | 2516 | RFTISRDNA KNTVYLQMN SLKPEDTAV YYCAA | 2534 | DQNTYG YMDRSD YEYDY | 2552 | WGQGT QVTVSS | 2570 |
| 203H9 | 2517 | RFTISRDNA KNTLYLQMN SLQPEDTAL YYCRR | 2535 | SLTLTD SPDL | 2553 | RSQGT QVTVSS | 2571 |
| 203H10 | 2518 | RFTISRDNA KNTVYLQMS SLKPEDTAIY SCAV | 2536 | ASGGGS IRSARR YDY | 2554 | WGRGT QVTVSS | 2572 |
| 202E4 | 2519 | RFTISRDNA KNTVYLQMN SLKPEDTAV YYCTL | 2537 | YRANL | 2555 | WGQGT QVTVSS | 2573 |
| 189E2 | 2520 | RFTISRDNA KNTVYLQMN SLKPEDTAV YYCNT | 2538 | RGPAAH EVRDY | 2556 | WGQGT QVTVSS | 2573 |
| PRSVPMP20C3 | 2606 | RFTISRDDK NTVYLQMNS LKPEDTAVY SCNA | 2614 | EGLIIAT MNGGV NYGMDY | 2622 | WGKGT LVTVSS | 2630 |
| PRSVPMP20C5 | 2607 | RFTISRDNA KNMVYLQM NSLKPEDTA VYYCNV | 2615 | RTPEVH TIRDY | 2623 | WGQGT QVTVSS | 2631 |
| PRSVPMP20B2 | 2608 | RFTISRDNA ENTVHLQMN SLKPEDTAV YTCAA | 2616 | DSTNRN SGAVYY TWAYDY | 2624 | WGQGT QVTVSS | 2632 |
| PRSVPMP20C1 | 2609 | RFTISGDNA KNTMYLQM NSLKPEDTA VYYCAA | 2617 | DSEILNS GAYYYP WAYVY | 2625 | WGQGT QVTVSS | 2633 |
| PRSVPMP1G8 | 2610 | RFTISRDNA NNIMYLQMN LLKPEDTAD YYCAA | 2618 | DPDPITA WKQSG AGMDY | 2626 | WGKGT QVTVSS | 2634 |
| PRSVNMP1A4 | 2611 | RFTISRDNA KNTGYLQM NSLAPDDTA VYYCGA | 2619 | GTPLNP GAYIYD WSYDY | 2627 | WGRGT QVTVSS | 2635 |

TABLE B-1-continued

Preferred combinations of CDR sequences, preferred combinations of framework sequences, and preferred combinations of framework and CDR sequences.

| | | | | | | | |
|---|---|---|---|---|---|---|---|
| PRSVPMP13E12 | 2612 | RFTMSRDNA KNTLYLQMN SLEPEDTAV YSCAA | 2620 | NSDTYYI YSDIVVP ERYDY | 2628 | WGQGT QVTVSS | 2636 |
| PRSVPMP5C6 | 2613 | QFTMSRDN AKSSVYLQM INLKPEDTAV YYCAA | 2621 | ATSPLF VASDYF DASRYDY | 2629 | WGQGT QVTVSS | 2637 |
| LG203E7 | 2826 | RFTISRDNA QKKIDLQMN SLRREDTAV YYCNA | 2862 | RYGSREY | 2898 | WGQGT QVTVSS | 2934 |
| LG203G8 | 2827 | RFTISRDNA QKKIDLQMN GLGREDTAV YYCNA | 2863 | QYGSREY | 2899 | WGQGT QVTVSS | 2935 |
| LG211A10 | 2828 | RFTVSRDNA KNTVYLQMN SLKPEDTAV YYCNL | 2864 | VSYGEYF | 2900 | WGKGT LVTVSS | 2936 |
| LG211A8 | 2829 | RFIFSEDEAK NTVHLQMNS LKPEDTAVY YCAA | 2865 | ALIGGY YSDVDA WSY | 2901 | WGPGT QVTVSS | 2937 |
| LG211B10 | 2830 | RFTISRDTAK NTVYLQMNS LKPEDTAVY YCNA | 2866 | EVIYYPY DY | 2902 | WGQGT QVTVSS | 2938 |
| LG211B8 | 2831 | RFIFSEDEAK NTVHLQMNS LKPEDTAVY YCAA | 2867 | ALIGGY YSDVDA WSY | 2903 | WGPGT QVTVSS | 2939 |
| LG211C12 | 2832 | RFTVSRDNA KNTVYLQMN SLKPEDTAV YYCNV | 2868 | VSYGEYF | 2904 | WGKGT LVTVSS | 2940 |
| LG211C8 | 2833 | RFAITRDAA KNTVHLQMN SLKPEDTAV YYCAA | 2869 | ATYGYG SYTYGG SYDL | 2905 | WGQGT QVTVSS | 2941 |
| LG211D10 | 2834 | RFTISRDSA GNTVYLQM NSLKPEDTA VYWCGA | 2870 | RQIGTY YSDYEN YDY | 2906 | WGQGT QVTVSS | 2942 |
| LG211D8 | 2835 | RFTMSRDSA SDTVYLQMN SLKPEDTAV YYCGA | 2871 | RQMGV YYSDYE NYDY | 2907 | WGQGT QVTVSS | 2943 |
| LG211E10 | 2836 | RFTISRDSA GNTVYLQM NSLKPEDTA VYWCGA | 2872 | RQIGTY YSDYEN YDY | 2908 | WGQGT QVTVSS | 2944 |
| LG211E12 | 2837 | RFTFSRDNA KNTVYLQLN SLKPEDTAV YHCAA | 2873 | ATLIGGY YSDLDN YDY | 2909 | WGPGT QVTVSS | 2945 |
| LG211E8 | 2838 | RFTMSRDSA SDTVYLQMN SLKPEDTAV YYCGA | 2874 | RQMGV YYSDYE NYDY | 2910 | WGQGT QVTVSS | 2946 |

TABLE B-1-continued

Preferred combinations of CDR sequences, preferred combinations of framework sequences, and preferred combinations of framework and CDR sequences.

| | | | | | | | |
|---|---|---|---|---|---|---|---|
| LG211H8 | 2839 | RFIFSEDEAKNTVHLQMNSLKPEDTAVYYCAA | 2875 | ALIGGYYSDVDAWSY | 2911 | WGPGTQVTVSS | 2947 |
| LG212A10 | 2840 | RFTVSRDNAKNTVYLQMNSLKPEDTAVYYCNV | 2876 | VSYGEYF | 2912 | WGKGTLVTVSS | 2948 |
| LG212A12 | 2841 | RFTVSRDNAKNTVYLQMNSLKPEDTAVYYCNV | 2877 | VSYGEYF | 2913 | WGKGTLVTVSS | 2949 |
| LG212A2 | 2842 | RFTISRDNAKNTEYLQMNSLKPEDTAVYYCAA | 2878 | REYGRLYSDSEAYDY | 2914 | WGQGTQVTVSS | 2950 |
| LG212A8 | 2843 | RFAITRDAAKNTVHLQMNSLKPEDTAVYYCAA | 2879 | ATYGYGSYTYGGSYDL | 2915 | WGQGTQVTVSS | 2951 |
| LG212B12 | 2844 | RFTISRDNAKNTLYLQMNSLKSEDTAVYYCAK | 2880 | DLYGSTWYTDY | 2916 | WSQGTQVTVSS | 2952 |
| LG212B2 | 2845 | RFTIFRDNDKNTVYLQMNSLKPEDTAVYYCAA | 2881 | GGFYGLRTTEERYDT | 2917 | WGQGTQVTVSS | 2953 |
| LG212C12 | 2846 | RFTISRDNAKNTLYLQMNSLKSEDTAVYYCAT | 2882 | DLYGSSWYTDY | 2918 | WSQGTQVTVSS | 2954 |
| LG212D10 | 2847 | RFAITRDAAKNTVHLQMNSLKPEDTAVYYCAA | 2883 | ATYGYGSYTYGGSYDL | 2919 | WGQGTQVTVSS | 2955 |
| LG212D12 | 2848 | RFAITRDAAKNTVHLQMNSLKPEDTAVYYCAA | 2884 | ATYGYGSYTYGGSYDL | 2920 | WGQGTQVTVSS | 2956 |
| LG212D2 | 2849 | RFTISRDNAKNTLYLQMNSLKPEDTAVYSCAT | 2885 | DFWGSTWS | 2921 | GLPGTQVTVSS | 2957 |
| LG212E10 | 2850 | RFTISRDTAKNTVYLQMNSLKPEDTAVYYCNA | 2886 | EVIYYPYDY | 2922 | WGQGTQVTVSS | 2958 |
| LG212E12 | 2851 | RFTISRDNAKSTVYLQMDSLKPEDTAVYYCAA | 2887 | ATYGYGSYTYQGSYDH | 2923 | WGQGTQVTVSS | 2959 |
| LG212E6 | 2852 | RFTISRDNAKNTLYLQMNSLKAEDTAVYYCAT | 2888 | EFWPGVYDT | 2924 | STPGTQVTVSS | 2960 |
| LG212F10 | 2853 | RFAITRDAAKNTVHLQMNSLKPEDTAVYYCAA | 2889 | ATYGYGSYTYGGSYDL | 2925 | WGQGTQVTVSS | 2961 |

TABLE B-1-continued

Preferred combinations of CDR sequences, preferred combinations of framework sequences, and preferred combinations of framework and CDR sequences.

| | | | | | | | | |
|---|---|---|---|---|---|---|---|---|
| LG212F12 | 2854 | RFTVSRDNA KNTVYLQMN SLKPEDTAV YYCNL | 2890 | VSYGEYF | 2926 | WGKGT LVTVSS | 2962 | |
| LG212F6 | 2855 | RFTISRDNA KNTLYLQMS SLKPEDTAV YYCAT | 2891 | GLYGGS TDDY | 2927 | WGQGT QVTVSS | 2963 | |
| LG212F8 | 2856 | RFTISRDTAK NTVYLQMNS LKPEDTAVY YCNA | 2892 | EVIYYPY DY | 2928 | WGQGT QVTVSS | 2964 | |
| LG212G10 | 2857 | RFAITRDAA KNTVHLQMN SLKPEDTAV YYCAA | 2893 | ATYGYG SYTYGG SYDL | 2929 | WGQGT QVTVSS | 2965 | |
| LG212G2 | 2858 | RFAISRDNA KNTLYLQMN SLKPEDTAV YYCAT | 2894 | DLYGST WYPG | 2930 | EDRGT QVTVSS | 2966 | |
| LG212H10 | 2859 | RFAITRDAA KNTVHLQMN SLKPEDTAV YYCAA | 2895 | ATYGYG SYTYGG SYDL | 2931 | WGQGT QVTVSS | 2967 | |
| LG212H2 | 2860 | RFTISRDNA KNTEYLQMN SLKPEDTAV YYCAA | 2896 | REYGRL YSDSEA YDY | 2932 | WGQGT QVTVSS | 2968 | |
| LG212H8 | 2861 | RFIITRDSAK NTIYLQMNS LQPADSGVY WCHG | 2897 | LGVVSN REY | 2933 | WGQGT QVTVSS | 2969 | |
| IV121 | 3324 | RFTISRDNP KNTMYLQM NSLKPEDTA VYYCNG | 3389 | RGPRYT TTGWIT DDY | 3454 | WGQGT QVTVSS | 3519 | |
| IV122 | 3325 | RFTISRDNA RNTVYLQMN SLKPEDTAV YYCYA | 3390 | RGPRKA PTGWIT DDY | 3455 | WGQGT QVTVSS | 3520 | |
| IV123 | 3326 | RFTISTDNAK TTVFLQMNS LKPEDTAVY YCNA | 3391 | RGPRR GTAGWI TDDY | 3456 | WGQGT QVTVSS | 3521 | |
| IV126 | 3327 | RFTISRDNP KNTLYLQMN SLEPEDTAV YYCHA | 3392 | RGPRYA TTGWFT DDY | 3457 | WGQGT QVTVSS | 3522 | |
| IV127 | 3328 | RFTISRDNT GNTAYLQM NSLKPEDTA VYYCYG | 3393 | RGPRKA PTGWIT DDY | 3458 | WGQGT QVTVSS | 3523 | |
| IV131 | 3329 | RFTISRGNA KNTVYLQMN SLKPEDTAV YYCAA | 3394 | EGPRRR GSTWYT DNY | 3459 | WGQGT QVTVSS | 3524 | |
| IV132 | 3330 | RFTISRDNA RNTVDLQM NSLKPEDTA VYYCYA | 3395 | RGPRHV PTGWIT DDY | 3460 | WGQGT QVTVSS | 3525 | |

TABLE B-1-continued

| Preferred combinations of CDR sequences, preferred combinations of framework sequences, and preferred combinations of framework and CDR sequences. | | | | | | | |
|---|---|---|---|---|---|---|---|
| IV133 | 3331 | RFTISRDNA KTTVYLQMN SLKPEDTAV YYCNA | 3396 | RGPRRA TTGWIT DDY | 3461 | WGQGT QVTVSS | 3526 |
| IV134 | 3332 | RFTISRGNA KNTVYLQMN SLKPEDTAV YYCAA | 3397 | EGPRRR GSTWYT DNY | 3462 | WGQGT QVTVSS | 3527 |
| IV135 | 3333 | RFTISRDNA ETAVYLQMN SLKPEDTAV YYCNA | 3398 | RGPRHA TTGWYT DDY | 3463 | WGQGT QVTVSS | 3528 |
| IV136 | 3334 | RFTISTDNAK TTVYLQMNS LKPEDTAVY YCNG | 3399 | RGPRRA TTGWIT DDY | 3464 | WGQGT QVTVSS | 3529 |
| IV140 | 3335 | RFTISRDNA RNTVYLQMN SLKPEDTAV YYCYA | 3400 | RGPRKA PTGWIT DDY | 3465 | WGQGT QVTVSS | 3530 |
| IV144 | 3336 | RFTISRDSA KNTIYLQMN SLKPEDTAV YFCAG | 3401 | EGPRRR GSTWYT DTY | 3466 | WGQGT QVTVSS | 3531 |
| IV156 | 3337 | RFTISTDNAK TTVFLQMNS LKPEDTAVY YCNG | 3402 | RGPRR GTAGW FTDDY | 3467 | WGQGT QVTVSS | 3532 |
| IV157 | 3338 | RFTISQDNA KTTVYLQMN SLKPEDTAV YYCNG | 3403 | RGPRYA TTGWYT DDY | 3468 | WGQGT QVTVSS | 3533 |
| IV160 | 3339 | RFTISQDNA KTTVYLQMN SLKPEDTAV YYCNG | 3404 | RGPRYA TTGWYT DDY | 3469 | WGQGT QVTVSS | 3534 |
| IV124 | 3340 | RFTISRDNA KNTVYLQMN SLKPEDTAV YYCNA | 3405 | GSTYSP FGDKYDY | 3470 | WGQGT QVTVSS | 3535 |
| IV125 | 3341 | RFTISRDNA KNTVYLHMN SLKPEDTAV YYCNA | 3406 | GSRFNP FGSAYDY | 3471 | WGQGT QVTVSS | 3536 |
| IV145 | 3342 | RFTISRDNA KNTVYLQMN SLKPEDTAV YYCNA | 3407 | GSRFNP FGSAYDY | 3472 | WGQGT QVTVSS | 3537 |
| IV146 | 3343 | RFTISRDNA KNTVYLQMN SLKPEDTAV YYCNA | 3408 | GSRFNP FGSAYDY | 3473 | WGQGT QVTVSS | 3538 |
| IV147 | 3344 | RFTISRDNA KNTVYLQMN SLKPEDTAV YYCNA | 3409 | GSRFNP FGSAYDY | 3474 | WGQGT QVTVSS | 3539 |
| IV151 | 3345 | RFTIFRDNA KNTVYLQMN GLKPDDTAI YRCAA | 3410 | RWDYG LWRPST YNYAY | 3475 | WGQGT QVIVSS | 3540 |

TABLE B-1-continued

Preferred combinations of CDR sequences, preferred combinations of framework sequences, and preferred combinations of framework and CDR sequences.

| | | | | | | | |
|---|---|---|---|---|---|---|---|
| IV153 | 3346 | RFTISGDNAKNTVYLQMSSLKPEDTAVYYCAA | 3411 | TLRSGSMWYQNVRVNDNPY | 3476 | WGQGTQVTVSS | 3541 |
| IV154 | 3347 | RFTISRDNTRNTLTLEMNSLKPEDTAVYYCAA | 3412 | RTYAGVRAHTYDYDY | 3477 | WGQGTQVTVSS | 3542 |
| IV155 | 3348 | RFTISRDNAKNMVYLQMNSLNPEDTAIYYCAA | 3413 | GTDAIFKPWMLPDY | 3478 | WGQGTQVTVSG | 3543 |
| IV1 | 3349 | RFTVSRDNAGNTMYLQMNSLRPEDTAVYICGA | 3414 | ASGYRSPDRLSEPNWVNY | 3479 | WGQGTQVTVSS | 3544 |
| IV2 | 3350 | RFTVSRDTANNTMYLQMNSLKPEDTAVYICGA | 3415 | ASGYRSTDRLSDPGWTNY | 3480 | WGQGTQVTVSS | 3545 |
| IV3 | 3351 | RFIVSRDNANNTMYLQMNSLKPEDTAVYICGA | 3416 | ASGYRSTDRLSEPAWINY | 3481 | WGQGTQVTVSS | 3546 |
| IV4 | 3352 | RFTVSRDNANNTMYLQMNSLKPEDTAVYICGA | 3417 | ASGYRSTDRLSTPEWINY | 3482 | WGQGTQVTVSS | 3547 |
| IV6 | 3353 | RFTVSRDNANNTMYLQMNSLKPEDTAVYICGA | 3418 | ATGYRSTDRLAEPGWVNY | 3483 | WGQGTQVTVSS | 3548 |
| IV7 | 3354 | RFTVSRDNANNTMYLQMNSLKPEDTAVYICGA | 3419 | ASGYRSTDRLSEPAWINY | 3484 | WGQGTQVTVSS | 3549 |
| IV9 | 3355 | RFTVSRDNANNTMYLQMNSLKPEDTAVYICGA | 3420 | ATGYRSTDRLTEPAWVNY | 3485 | WGQGTQVTVSS | 3550 |
| IV10 | 3356 | RFTVSRDNANNTMYLQMNSLKPEDTAVYICGA | 3421 | ATGYRSTDRLSDPNWVNY | 3486 | WGQGTQVTVSS | 3551 |
| IV11 | 3357 | RFTVSRDNANNTMYLRMNSLKPEDTAVYICGA | 3422 | ASGYRSTDRLSDAAWINY | 3487 | WGQGTQVTVSS | 3552 |
| IV12 | 3358 | RFTVSRDNANNTMYLQMNSLKPEDTAVYICGA | 3423 | ASGYRSTDRLSTPEWINY | 3488 | WGQGTQVTVSS | 3553 |
| IV16 | 3359 | RFTVSRDNGNNTMYLQMNSLKPEDTAVYICGV | 3424 | ASGYRSTDRLSEPGWINY | 3489 | WGQGTQVTVSS | 3554 |
| IV24 | 3360 | RFTVSRDTANNTMYLEMNRLKPDDTAVYICGA | 3425 | ATGYRSTDRLSTPAWINY | 3490 | WGQGTQVTVSS | 3555 |

TABLE B-1-continued

Preferred combinations of CDR sequences, preferred combinations of framework sequences, and preferred combinations of framework and CDR sequences.

| | | | | | | | |
|---|---|---|---|---|---|---|---|
| IV26 | 3361 | RFTVSRDNA NNTMYLQM NSLKPEDTA VYICGA | 3426 | ASGYRS TDRLSD PAWTNY | 3491 | WGQGT QVTVSS | 3556 |
| IV30 | 3362 | RFTVSRDNA NNTMYLQM NSLKPEDTA VYICGA | 3427 | ASGYRS PDRLSE PEWINY | 3492 | WGQGT QVTVSS | 3557 |
| IV34 | 3363 | RFTVSRDMA NNTMYLQM NSLKPEDTA VYICGA | 3428 | ASGYRS TDRLSE PGWVNY | 3493 | WGQGT QVTVSS | 3558 |
| IV14 | 3364 | RFTISKDNA KSTVYLDMN SLKPEDTAV YYCAA | 3429 | DRKTLA YYTSRL RSRYDY | 3494 | WGQGT QVTVSS | 3559 |
| IV15 | 3365 | RFTISKDNA KSTVYLDMN SLKPEDTAV YYCAA | 3430 | DRKTLT YYTSRL RSRYDY | 3495 | WGQGT QVTVSS | 3560 |
| IV17 | 3366 | RFTISKDNA KSTVYLDMN SLKPEDTAV YYCAA | 3431 | DRKTLT FYTSRL RSRYDY | 3496 | WGQGT QVTVSS | 3561 |
| IV18 | 3367 | RFTISKDNA KSTVYLDMN SLKPEDTAV YYCAA | 3432 | DRKTLT FYTSRL RSRYDY | 3497 | WGQGT QVTVSS | 3562 |
| IV29 | 3368 | RFTISKDNA KSTVYLDMN SLKPEDTAV YYCAA | 3433 | DRKTLT YYTSRL RSRYEY | 3498 | WGQGT QVTVSS | 3563 |
| IV31 | 3369 | RFTISKDNA KSTVVLDMN SLKPEDTAV YYCAA | 3434 | DGKTLT FYTSRL RSRYDY | 3499 | WGQGT QVTVSS | 3564 |
| IV33 | 3370 | RFSISKDLAK STVYLDMNS LKPEDTAVY YCAA | 3435 | DQKTLT FYTSRL RSRYDY | 3500 | WGQGT QVTVSS | 3565 |
| IV35 | 3371 | RFTISKDNA KSTVYLDMN SLKPEDTAV YYCAA | 3436 | DRKTLT FYTSRL RSRYDY | 3501 | WGQGT QVTVSS | 3566 |
| IV36 | 3372 | RFTISKDYAK STVYLDMNS LKPEDTAVY YCAA | 3437 | DQKTLT YYTSRL RSRYDY | 3502 | WGQGT QVTVSS | 3567 |
| IV40 | 3373 | RFTISKDNA KRTVYLDMN SLKPEDTAV YYCAA | 3438 | DGKTLT YYTSRL RSQYDY | 3503 | WGQGT QVTVSS | 3568 |
| IV42 | 3374 | RFTISKDNA KSTVYLDMN SLKPEDTAV YYCAA | 3439 | DRKTLT FYTSRL RSRYDY | 3504 | WGQGT QVTVSS | 3569 |
| IV8 | 3375 | RFTISRDNA RNTVYLQMN RLKSEDSAV YYCAA | 3440 | HASYDR MIYSEY KY | 3505 | WGQGT QVTVSS | 3570 |

TABLE B-1-continued

Preferred combinations of CDR sequences, preferred combinations of framework sequences, and preferred combinations of framework and CDR sequences.

| | | | | | | | |
|---|---|---|---|---|---|---|---|
| IV21 | 3376 | RFTISRDNA RDTVYLQMN RLNPEDSAV YYCAA | 3441 | HANYDR MINSEY KY | 3506 | WGQGT QVTVSS | 3571 |
| IV23 | 3377 | RFTISRDNA RDTVYLQMN RLNPEDSAV YYCAA | 3442 | HANYDR MINSEY KY | 3507 | WGQGT QVTVSS | 3572 |
| IV45 | 3378 | RFTISRDNA RNTVYLQMN RLKPEDSAV YYCAA | 3443 | HASYDR MINSEY KY | 3508 | WGQGT QVTVSS | 3573 |
| IV47 | 3379 | RFTISRDNA RNTVLLQMN RLKPEDSAV YYCAA | 3444 | HANYDR MINSEY KY | 3509 | WGQGT QVTVSS | 3574 |
| IV48 | 3380 | RFTISRDNA RNTVYLQMN RLKPEDSAV YYCAG | 3445 | HASYDR MINSEY KY | 3510 | WGQGT QVTVSS | 3575 |
| IV50 | 3381 | RFTISRDNA RNTVYLQMN RLKPEDSAV YYCAA | 3446 | HASYDR MIYSEY KY | 3511 | WGQGT QVTVSS | 3576 |
| IV22 | 3382 | RFTISRDNA KNTLYLQMN SLKPEDTAV YYCAI | 3447 | DPRADL VATMTSI RY | 3512 | WGQGT QVTVSS | 3577 |
| IV37 | 3383 | RFTISRDNA KNTFYLQMN SLKPEDTAV YYCAI | 3448 | DPRADL VATMTSI RY | 3513 | WGQGT QVTVSS | 3578 |
| IV38 | 3384 | RFTISRDNA KNTLYLQMN SLKPEDTAV YYCAI | 3449 | DPRADL VATMTSI RY | 3514 | WGQGT QVTVSS | 3579 |
| IV5 | 3385 | RFTISGDNA GNTVDLQM NSLKPEDTA VYACAA | 3450 | MSKPRN LWRTDS YDY | 3515 | WGQGT QVTVSS | 3580 |
| IV27 | 3386 | RFTISRGNA KNTVDLQMN SLKPEDTAV YACAA | 3451 | MSKPYN LWRTDS YDY | 3516 | WGQGT QVTVSS | 3581 |
| IV25 | 3387 | RFTISRDNA KNTMYLQM NALKPEDTA VYYCAA | 3452 | ARDPDL YTGQYEY | 3517 | WGQGT QVTVSS | 3582 |
| IV28 | 3388 | RFTISRDSA KNTLYLQMN SLKSEDTAV YYCAK | 3453 | GEGSAN WGLDF GS | 3518 | WGQGT QVTVSS | 3583 |

("ID" refers to the SEQ ID NO as used herein)

Thus, in the preferred NANOBODIES® ($V_{HH}$ sequences) of the invention, at least one of the CDR1, CDR2 and CDR3 sequences present is suitably chosen from the group consisting of the CDR1, CDR2 and CDR3 sequences, respectively, listed in Table B-1; or from the group of CDR1, CDR2 and CDR3 sequences, respectively, that have at least 80%, preferably at least 90%, more preferably at least 95%, even more preferably at least 99% "sequence identity" (as defined herein) with at least one of the CDR1, CDR2 and CDR3 sequences, respectively, listed in Table B-1; and/or from the group consisting of the CDR1, CDR2 and CDR3 sequences, respectively, that have 3, 2 or only 1 "amino acid difference(s)" (as defined herein) with at least one of the CDR1, CDR2 and CDR3 sequences, respectively, listed in Table B-1.

In this context, by "suitably chosen" is meant that, as applicable, a CDR1 sequence is chosen from suitable CDR1 sequences (i.e. as defined herein), a CDR2 sequence is chosen from suitable CDR2 sequences (i.e. as defined herein), and a CDR3 sequence is chosen from suitable CDR3 sequence (i.e. as defined herein), respectively. More in particular, the CDR sequences are preferably chosen such that the NANOBODIES® ($V_{HH}$ sequences) of the invention bind to an envelope protein of a virus with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

In particular, in the preferred NANOBODIES® ($V_{HH}$ sequences) of the invention, at least the CDR3 sequence present is suitably chosen from the group consisting of the CDR3 sequences listed in Table B-1 or from the group of CDR3 sequences that have at least 80%, preferably at least 90%, more preferably at least 95%, even more preferably at least 99% sequence identity with at least one of the CDR3 sequences listed in Table B-1; and/or from the group consisting of the CDR3 sequences that have 3, 2 or only 1 amino acid difference(s) with at least one of the CDR3 sequences listed in Table B-1.

Preferably, in the NANOBODIES® ($V_{HH}$ sequences) of the invention, at least two of the CDR1, CDR2 and CDR3 sequences present are suitably chosen from the group consisting of the CDR1, CDR2 and CDR3 sequences, respectively, listed in Table B-1 or from the group consisting of CDR1, CDR2 and CDR3 sequences, respectively, that have at least 80%, preferably at least 90%, more preferably at least 95%, even more preferably at least 99% sequence identity with at least one of the CDR1, CDR2 and CDR3 sequences, respectively, listed in Table B-1; and/or from the group consisting of the CDR1, CDR2 and CDR3 sequences, respectively, that have 3, 2 or only 1 "amino acid difference(s)" with at least one of the CDR1, CDR2 and CDR3 sequences, respectively, listed in Table B-1.

In particular, in the NANOBODIES® ($V_{HH}$ sequences) of the invention, at least the CDR3 sequence present is suitably chosen from the group consisting of the CDR3 sequences listed in Table B-1 or from the group of CDR3 sequences that have at least 80%, preferably at least 90%, more preferably at least 95%, even more preferably at least 99% sequence identity with at least one of the CDR3 sequences listed in Table B-1, respectively; and at least one of the CDR1 and CDR2 sequences present is suitably chosen from the group consisting of the CDR1 and CDR2 sequences, respectively, listed in Table B-1 or from the group of CDR1 and CDR2 sequences, respectively, that have at least 80%, preferably at least 90%, more preferably at least 95%, even more preferably at least 99% sequence identity with at least one of the CDR1 and CDR2 sequences, respectively, listed in Table B-1; and/or from the group consisting of the CDR1 and CDR2 sequences, respectively, that have 3, 2 or only 1 amino acid difference(s) with at least one of the CDR1 and CDR2 sequences, respectively, listed in Table B-1.

Most preferably, in the NANOBODIES® ($V_{HH}$ sequences) of the invention, all three CDR1, CDR2 and CDR3 sequences present are suitably chosen from the group consisting of the CDR1, CDR2 and CDR3 sequences, respectively, listed in Table B-1 or from the group of CDR1, CDR2 and CDR3 sequences, respectively, that have at least 80%, preferably at least 90%, more preferably at least 95%, even more preferably at least 99% sequence identity with at least one of the CDR1, CDR2 and CDR3 sequences, respectively, listed in Table B-1; and/or from the group consisting of the CDR1, CDR2 and CDR3 sequences, respectively, that have 3, 2 or only 1 amino acid difference(s) with at least one of the CDR1, CDR2 and CDR3 sequences, respectively, listed in Table B-1.

Even more preferably, in the NANOBODIES® ($V_{HH}$ sequences) of the invention, at least one of the CDR1, CDR2 and CDR3 sequences present is suitably chosen from the group consisting of the CDR1, CDR2 and CDR3 sequences, respectively, listed in Table B-1. Preferably, in this aspect, at least one or preferably both of the other two CDR sequences present are suitably chosen from CDR sequences that have at least 80%, preferably at least 90%, more preferably at least 95%, even more preferably at least 99% sequence identity with at least one of the corresponding CDR sequences, respectively, listed in Table B-1; and/or from the group consisting of the CDR sequences that have 3, 2 or only 1 amino acid difference(s) with at least one of the corresponding sequences, respectively, listed in Table B-1.

In particular, in the NANOBODIES® ($V_{HH}$ sequences) of the invention, at least the CDR3 sequence present is suitably chosen from the group consisting of the CDR3 listed in Table B-1. Preferably, in this aspect, at least one and preferably both of the CDR1 and CDR2 sequences present are suitably chosen from the groups of CDR1 and CDR2 sequences, respectively, that have at least 80%, preferably at least 90%, more preferably at least 95%, even more preferably at least 99% sequence identity with the CDR1 and CDR2 sequences, respectively, listed in Table B-1; and/or from the group consisting of the CDR1 and CDR2 sequences, respectively, that have 3, 2 or only 1 amino acid difference(s) with at least one of the CDR1 and CDR2 sequences, respectively, listed in Table B-1.

Even more preferably, in the NANOBODIES® ($V_{HH}$ sequences) of the invention, at least two of the CDR1, CDR2 and CDR3 sequences present are suitably chosen from the group consisting of the CDR1, CDR2 and CDR3 sequences, respectively, listed in Table B-1. Preferably, in this aspect, the remaining CDR sequence present is suitably chosen from the group of CDR sequences that have at least 80%, preferably at least 90%, more preferably at least 95%, even more preferably at least 99% sequence identity with at least one of the corresponding CDR sequences listed in Table B-1; and/or from the group consisting of CDR sequences that have 3, 2 or only 1 amino acid difference(s) with at least one of the corresponding sequences listed in Table B-1.

In particular, in the NANOBODIES® ($V_{HH}$ sequences) of the invention, at least the CDR3 sequence is suitably chosen from the group consisting of the CDR3 sequences listed in Table B-1, and either the CDR1 sequence or the CDR2 sequence is suitably chosen from the group consisting of the CDR1 and CDR2 sequences, respectively, listed in Table B-1. Preferably, in this aspect, the remaining CDR sequence present is suitably chosen from the group of CDR sequences that have at least 80%, preferably at least 90%, more preferably at least 95%, even more preferably at least 99% sequence identity with at least one of the corresponding CDR sequences listed in Table B-1; and/or from the group consisting of CDR sequences that have 3, 2 or only 1 amino acid difference(s) with the corresponding CDR sequences listed in Table B-1.

Even more preferably, in the NANOBODIES® ($V_{HH}$ sequences) of the invention, all three CDR1, CDR2 and CDR3 sequences present are suitably chosen from the group consisting of the CDR1, CDR2 and CDR3 sequences, respectively, listed in Table B-1.

Also, generally, the combinations of CDR's listed in Table B-1 (i.e. those mentioned on the same line in Table B-1) are preferred. Thus, it is generally preferred that, when a CDR in a NANOBODY® ($V_{HH}$ sequence) of the invention is a CDR sequence mentioned in Table B-1 or is suitably chosen from the group of CDR sequences that have at least 80%, preferably at least 90%, more preferably at least 95%, even more preferably at least 99% sequence identity with a CDR sequence listed in Table B-1; and/or from the group consisting of CDR sequences that have 3, 2 or only 1 amino acid difference(s) with a CDR sequence listed in Table B-1, that at least one and preferably both of the other CDR's are suitably chosen from the CDR sequences that belong to the same combination in Table B-1 (i.e. mentioned on the same line in Table B-1) or are suitably chosen from the group of CDR sequences that have at least 80%, preferably at least 90%, more preferably at least 95%, even more preferably at least 99% sequence identity with the CDR sequence(s) belonging to the same combination and/or from the group consisting of CDR sequences that have 3, 2 or only 1 amino acid difference(s) with the CDR sequence(s) belonging to the same combination. The other preferences indicated in the above paragraphs also apply to the combinations of CDR's mentioned in Table B-1.

Thus, by means of non-limiting examples, a NANOBODY® ($V_{HH}$ sequence) of the invention can for example comprise a CDR1 sequence that has more than 80% sequence identity with one of the CDR1 sequences mentioned in Table B-1, a CDR2 sequence that has 3, 2 or 1 amino acid difference with one of the CDR2 sequences mentioned in Table B-1 (but belonging to a different combination), and a CDR3 sequence.

Some preferred NANOBODIES® ($V_{HH}$ sequences) of the invention may for example comprise: (1) a CDR1 sequence that has more than 80% sequence identity with one of the CDR1 sequences mentioned in Table B-1; a CDR2 sequence that has 3, 2 or 1 amino acid difference with one of the CDR2 sequences mentioned in Table B-1 (but belonging to a different combination); and a CDR3 sequence that has more than 80% sequence identity with one of the CDR3 sequences mentioned in Table B-1 (but belonging to a different combination); or (2) a CDR1 sequence that has more than 80% sequence identity with one of the CDR1 sequences mentioned in Table B-1; a CDR2 sequence, and one of the CDR3 sequences listed in Table B-1; or (3) a CDR1 sequence; a CDR2 sequence that has more than 80% sequence identity with one of the CDR2 sequence listed in Table B-1; and a CDR3 sequence that has 3, 2 or 1 amino acid differences with the CDR3 sequence mentioned in Table B-1 that belongs to the same combination as the CDR2 sequence.

Some particularly preferred NANOBODIES® ($V_{HH}$ sequences) of the invention may for example comprise: (1) a CDR1 sequence that has more than 80% sequence identity with one of the CDR1 sequences mentioned in Table B-1; a CDR2 sequence that has 3, 2 or 1 amino acid difference with the CDR2 sequence mentioned in Table B-1 that belongs to the same combination; and a CDR3 sequence that has more than 80% sequence identity with the CDR3 sequence mentioned in Table B-1 that belongs to the same combination; (2) a CDR1 sequence; a CDR 2 listed in Table B-1 and a CDR3 sequence listed in Table B-1 (in which the CDR2 sequence and CDR3 sequence may belong to different combinations).

Some even more preferred NANOBODIES® ($V_{HH}$ sequences) of the invention may for example comprise: (1) a CDR1 sequence that has more than 80% sequence identity with one of the CDR1 sequences mentioned in Table B-1; the CDR2 sequence listed in Table B-1 that belongs to the same combination; and a CDR3 sequence mentioned in Table B-1 that belongs to a different combination; or (2) a CDR1 sequence mentioned in Table B-1; a CDR2 sequence that has 3, 2 or 1 amino acid differences with the CDR2 sequence mentioned in Table B-1 that belongs to the same combination; and a CDR3 sequence that has more than 80% sequence identity with the CDR3 sequence listed in Table B-1 that belongs to the same or a different combination.

Particularly preferred NANOBODIES® ($V_{HH}$ sequences) of the invention may for example comprise a CDR1 sequence mentioned in Table B-1, a CDR2 sequence that has more than 80% sequence identity with the CDR2 sequence mentioned in Table B-1 that belongs to the same combination; and the CDR3 sequence mentioned in Table B-1 that belongs to the same combination.

In the most preferred NANOBODIES® ($V_{HH}$ sequences) of the invention, the CDR1, CDR2 and CDR3 sequences present are suitably chosen from one of the combinations of CDR1, CDR2 and CDR3 sequences, respectively, listed in Table B-1.

According to another preferred, but non-limiting aspect of the invention (a) CDR1 has a length of between 1 and 12 amino acid residues, and usually between 2 and 9 amino acid residues, such as 5, 6 or 7 amino acid residues; and/or (b) CDR2 has a length of between 13 and 24 amino acid residues, and usually between 15 and 21 amino acid residues, such as 16 and 17 amino acid residues; and/or (c) CDR3 has a length of between 2 and 35 amino acid residues, and usually between 3 and 30 amino acid residues, such as between 6 and 23 amino acid residues.

In another preferred, but non-limiting aspect, the invention relates to a NANOBODY® ($V_{HH}$ sequence) in which the CDR sequences (as defined herein) have more than 80%, preferably more than 90%, more preferably more than 95%, such as 99% or more sequence identity (as defined herein) with the CDR sequences of at least one of the amino acid sequences of SEQ ID NO's: 126 to 407, 2431 to 2448, 2574 to 2581, 2682 to 2717 and 3064 to 3128 (see Table A-1).

Generally, NANOBODIES® ($V_{HH}$ sequences) with the above CDR sequences may be as further described herein, and preferably have framework sequences that are also as further described herein. Thus, for example and as mentioned herein, such NANOBODIES® ($V_{HH}$ sequences) may be naturally occurring NANOBODIES® ($V_{HH}$ sequences) (from any suitable species), naturally occurring $V_{HH}$ sequences (i.e. from a suitable species of Camelid) or synthetic or semi-synthetic amino acid sequences or NANOBODIES® ($V_{HH}$ sequences), including but not limited to partially humanized NANOBODIES® ($V_{HH}$ sequences) or $V_{HH}$ sequences, fully humanized NANOBODIES® ($V_{HH}$ sequences) or $V_{HH}$ sequences, camelized heavy chain variable domain sequences, as well as NANOBODIES® ($V_{HH}$ sequences) that have been obtained by the techniques mentioned herein.

Thus, in one specific, but non-limiting aspect, the invention relates to a humanized NANOBODY® ($V_{HH}$ sequence), which consists of 4 framework regions (FR1 to FR4 respectively) and 3 complementarity determining regions (CDR1 to CDR3 respectively), in which CDR1 to CDR3 are as defined herein and in which said humanized NANOBODY® ($V_{HH}$ sequence) comprises at least one humanizing substitution (as defined herein), and in particular at least one humanizing substitution in at least one of its framework sequences (as defined herein).

In another preferred, but non-limiting aspect, the invention relates to a NANOBODY® ($V_{HH}$ sequence) in which the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 126 to 407, 2431 to 2448, 2574 to 2581, 2682 to 2717 and 3064 to 3128 (see Table A-1). This degree of amino acid identity can for example be determined by determining the degree of amino acid identity (in a manner described herein) between said NANOBODY® ($V_{HH}$ sequence) and one or more of the sequences of SEQ ID NO's: 126 to 407, 2431 to 2448, 2574 to 2581, 2682 to 2717 and 3064 to 3128 (see Table A-1), in which the amino acid residues that form the framework regions are disregarded. Such NANOBODIES® ($V_{HH}$ sequences) can be as further described herein.

In another preferred, but non-limiting aspect, the invention relates to a NANOBODY® ($V_{HH}$ sequence) with an amino acid sequence that is chosen from the group consisting of SEQ ID NO's: 126 to 407, 2431 to 2448, 2574 to 2581, 2682 to 2717 and 3064 to 3128 (see Table A-1) or from the group consisting of amino acid sequences that have more than 80%, preferably more than 90%, more preferably more than 95%, such as 99% or more sequence identity (as defined herein) with at least one of the amino acid sequences of SEQ ID NO's: 126 to 407, 2431 to 2448, 2574 to 2581, 2682 to 2717 and 3064 to 3128 (see Table A-1).

Another preferred, but non-limiting aspect of the invention relates to humanized variants of the NANOBODIES® ($V_{HH}$ sequences) of SEQ ID NO's: 126 to 407, 2431 to 2448, 2574 to 2581, 2682 to 2717 and 3064 to 3128 (see Table A-1), that comprise, compared to the corresponding native $V_{HH}$ sequence, at least one humanizing substitution (as defined herein), and in particular at least one humanizing substitution in at least one of its framework sequences (as defined herein). Some preferred, but non-limiting examples of such humanized variants are the humanized NANOBODIES® ($V_{HH}$ sequences) of SEQ ID NO's: 2999 to 3015 (see Table A-8). Thus, the invention also relates to a humanized NANOBODY® ($V_{HH}$ sequence) with an amino acid sequence that is chosen from the group consisting of SEQ ID NO's: 2999 to 3015 (see Table A-8) or from the group consisting of from amino acid sequences that have more than 80%, preferably more than 90%, more preferably more than 95%, such as 99% or more sequence identity (as defined herein) with at least one of the amino acid sequences of SEQ ID NO's: 2999 to 3015 (see Table A-8) (in which amino acid sequences that are chosen from the latter group of amino acid sequences may contain a greater number or a smaller number of humanizing substitutions compared to the corresponding sequence of SEQ ID NO's: 2999 to 3015 (see Table A-8), as long as they retain at least one of the humanizing substitutions present in the corresponding sequence of SEQ ID NO's: 2999 to 3015 (see Table A-8)).

The polypeptides of the invention comprise or essentially consist of at least one NANOBODY® ($V_{HH}$ sequence) of the invention. Some preferred, but non-limiting examples of polypeptides of the invention are given in SEQ ID NO's: 2382 to 2415, 2423 to 2430, 2641 to 2659, 2663 to 2681, 2978 to 2998, 3016 to 3056 and 3584 to 3591 (see Table A-2, Table A-4, Table A-5, Table A-6, Table A-9, Table A-10).

It will be clear to the skilled person that the NANOBODIES® ($V_{HH}$ sequences) that are mentioned herein as "preferred" (or "more preferred", "even more preferred", etc.) are also preferred (or more preferred, or even more preferred, etc.) for use in the polypeptides described herein. Thus, polypeptides that comprise or essentially consist of one or more "preferred" NANOBODIES® ($V_{HH}$ sequences) of the invention will generally be preferred, and polypeptides that comprise or essentially consist of one or more "more preferred" NANOBODIES® ($V_{HH}$ sequences) of the invention will generally be more preferred, etc. Generally, proteins or polypeptides that comprise or essentially consist of a single NANOBODY® ($V_{HH}$ sequence) (such as a single NANOBODY® ($V_{HH}$ sequence) of the invention) will be referred to herein as "monovalent" proteins or polypeptides or as "monovalent constructs". Proteins and polypeptides that comprise or essentially consist of two or more NANOBODIES® ($V_{HH}$ sequences) (such as at least two NANOBODIES® ($V_{HH}$ sequences) of the invention or at least one NANOBODY® ($V_{HH}$ sequence) of the invention and at least one other NANOBODY® ($V_{HH}$ sequence)) will be referred to herein as "multivalent" proteins or polypeptides or as "multivalent constructs", and these may provide certain advantages compared to the corresponding monovalent NANOBODIES® ($V_{HH}$ sequences) of the invention. Some non-limiting examples of such multivalent constructs will become clear from the further description herein.

According to one specific, but non-limiting aspect, a polypeptide of the invention comprises or essentially consists of at least two NANOBODIES® ($V_{HH}$ sequences) of the invention, such as two or three NANOBODIES® ($V_{HH}$ sequences) of the invention. As further described herein, such multivalent constructs can provide certain advantages compared to a protein or polypeptide comprising or essentially consisting of a single NANOBODY® ($V_{HH}$ sequence) of the invention, such as a much improved avidity for an envelope protein of a virus. Such multivalent constructs or polypeptides will be clear to the skilled person based on the disclosure herein.

In a preferred, but non-limiting aspect, the polypeptides of the invention are bivalent and are directed against the Synagis® binding site on the RSV F protein and/or capable of competing with Synagis® for binding to the RSV F protein. The polypeptides of the invention may be directed against antigenic site II (also referred to as site A) of the RSV F protein as well as against at least one other antigenic determinant, epitope, part or domain on the RSV F protein. In a preferred aspect, the polypeptides of the invention are directed against region aa 250-275 of the RSV F protein as well as against at least one other antigenic determinant, epitope, part or domain on the RSV F protein.

Generally, such a bivalent polypeptide of the invention may contain two NANOBODIES® ($V_{HH}$ sequences) of the invention that are capable of binding to the Synagis® binding site on the RSV F protein and/or capable of competing with Synagis® for binding to the RSV F protein (and in particular against antigenic site II (also referred to as site A) of the RSV F protein and more preferably against region aa 250-275 of the RSV F protein). Generally, such bivalent polypeptides of the invention may be as further described herein, and the various preferred aspects of the invention as described herein also apply to these bivalent polypeptides of the invention (for example, these bivalent polypeptides of the invention may comprise suitable linkers; and are preferably such that they can simultaneously bind the Synagis® binding sites).

In another preferred, but non-limiting aspect, the polypeptides of the invention are bivalent and are directed against the 101F binding site on the RSV F protein and/or capable of competing with 101F for binding to the RSV F protein, The polypeptides of the invention may be directed against antigenic site IV-VI of the RSV F protein as well as against at least one other antigenic determinant on the RSV F protein. In a preferred aspect, the polypeptides of the invention are directed against region aa 423-436 of the RSV F protein as well as against at least one other antigenic determinant on the RSV F protein.

Generally, such a bivalent polypeptide of the invention will contain two NANOBODIES® ($V_{HH}$ sequences) of the invention that are capable of binding to the 101F binding site on the RSV F protein and/or capable of competing with 101F for binding to the RSV F protein (and in particular against antigenic site IV-VI of the RSV F protein and more preferably against region aa 423-436 of the RSV F protein). Generally, such bivalent polypeptides of the invention may be as further described herein, and the various preferred aspects of the invention as described herein also apply to these bivalent polypeptides of the invention (for example, these bivalent polypeptides of the invention may comprise suitable linkers; and are preferably such that they can simultaneously bind the 101F binding sites).

In another preferred, but non-limiting aspect, the polypeptides of the invention are bivalent and are directed against the sialic acid binding site on the hemagglutinin H5 envelope protein of influenza virus and/or capable of competing with sialic acid for binding to the hemagglutinin H5 envelope protein of influenza virus.

Generally, such a bivalent polypeptide of the invention will contain two NANOBODIES® ($V_{HH}$ sequences) of the invention that are capable of binding to the sialic acid binding site on the hemagglutinin H5 envelope protein of influenza virus and/or capable of competing with sialic acid for binding to the hemagglutinin H5 envelope protein of influenza virus. Generally, such bivalent polypeptides of the invention may be as further described herein, and the various preferred aspects of the invention as described herein also apply to these bivalent polypeptides of the invention (for example, these bivalent polypeptides of the invention may comprise suitable linkers; and are preferably such that they can simultaneously bind the sialic acid binding site).

In another preferred, but non-limiting aspect, the polypeptides of the invention are bivalent and are directed against the VN04-2 binding site on the hemagglutinin H5 envelope protein of influenza virus and/or capable of competing with VN04-2 for binding to the hemagglutinin H5 envelope protein of influenza virus.

Generally, such a bivalent polypeptide of the invention will contain two NANOBODIES® ($V_{HH}$ sequences) of the invention that are capable of binding to the VN04-2 binding site on the hemagglutinin H5 envelope protein of influenza virus and/or capable of competing with VN04-2 for binding to the hemagglutinin H5 envelope protein of influenza virus. Generally, such bivalent polypeptides of the invention may be as further described herein, and the various preferred aspects of the invention as described herein also apply to these bivalent polypeptides of the invention (for example, these bivalent polypeptides of the invention may comprise suitable linkers; and are preferably such that they can simultaneously bind the VN04-2 binding site).

In another preferred, but non-limiting aspect, the polypeptides of the invention are bivalent and are directed against the MAb C179 binding site on the hemagglutinin H5 envelope protein of influenza virus and/or capable of competing with MAb C179 for binding to the hemagglutinin H5 envelope protein of influenza virus.

Generally, such a bivalent polypeptide of the invention will contain two NANOBODIES® ($V_{HH}$ sequences) of the invention that are capable of binding to the MAb C179 binding site on the hemagglutinin H5 envelope protein of influenza virus and/or capable of competing with MAb C179 for binding to the hemagglutinin H5 envelope protein of influenza virus. Generally, such bivalent polypeptides of the invention may be as further described herein, and the various preferred aspects of the invention as described herein also apply to these bivalent polypeptides of the invention (for example, these bivalent polypeptides of the invention may comprise suitable linkers; and are preferably such that they can simultaneously bind the MAb C179 binding site).

In another preferred, but non-limiting aspect, the polypeptides of the invention are bivalent and are directed against the MAb 8-2 binding site on the G envelope protein of rabies and/or capable of competing with MAb 8-2 for binding to the G envelope protein.

Generally, such a bivalent polypeptide of the invention will contain two NANOBODIES® ($V_{HH}$ sequences) of the invention that are capable of binding to the MAb 8-2 binding site on the G envelope protein and/or capable of competing with MAb 8-2 for binding to the G envelope protein. Generally, such bivalent polypeptides of the invention may be as further described herein, and the various preferred aspects of the invention as described herein also apply to these bivalent polypeptides of the invention (for example, these bivalent polypeptides of the invention may comprise suitable linkers; and are preferably such that they can simultaneously bind the MAb 8-2 binding site).

In a preferred aspect, the polypeptides of the invention are capable of binding to two or more different antigenic determinants, epitopes, parts, domains of an envelope protein of a virus. In this context, the polypeptides of the invention are also referred to as "multiparatopic" (such as e.g. "biparatopic" or "triparatopic", etc.) polypeptides. The multiparatopic polypeptides of the invention can be directed against any antigenic determinants, epitopes, parts, and/or domains of the envelope protein of a virus.

For example, and generally, a biparatopic polypeptide of the invention may comprise at least one NANOBODY® ($V_{HH}$ sequence) of the invention directed against a first antigenic determinant, epitope, part or domain of the viral envelope protein and at least one NANOBODY® ($V_{HH}$ sequence) of the invention directed against a second antigenic determinant, epitope, part or domain of the viral envelope protein different from the first antigenic determinant, epitope, part or domain (in which said NANOBODIES® ($V_{HH}$ sequences) may be suitably linked, for example via a suitable linker as further described herein). Preferably, such a biparatopic polypeptide of the invention is further such that, when it binds to the viral envelope protein, it is capable of simultaneously binding to the first antigenic determinant, epitope, part or domain (i.e. via the at least one NANOBODY® ($V_{HH}$ sequence) of the invention capable of binding to said first antigenic determinant, epitope, part or domain) and binding to said second antigenic determinant, epitope, part or domain (i.e. via the at least one NANOBODY® ($V_{HH}$ sequence) of the invention capable of binding to said second antigenic determinant, epitope, part or domain). Examples of such biparatopic polypeptides of the invention will become clear from the further description herein. Also, a triparatopic polypeptide of the invention may comprise at least one further NANOBODY® ($V_{HH}$ sequence) of the invention directed against a third antigenic determinant, epitope, part or domain of the viral envelope protein (different from both the first and second antigenic determinant, epitope, part or domain), and generally multiparatopic polypeptides of the invention may contain at least two NANOBODIES® ($V_{HH}$ sequences) of the invention directed against at least two different antigenic determinants, epitopes, parts or domains of the viral envelope protein. Generally, such biparatopic, triparatopic and multiparatopic polypeptides of the invention may be as further described herein.

In a preferred, but non-limiting aspect, the polypeptides of the invention are biparatopic (or multiparatopic) and are directed against the Synagis® binding site on the RSV F protein and/or capable of competing with Synagis® for binding to the RSV F protein, as well as against at least one other antigenic determinant, epitope, part or domain on the RSV F protein. The polypeptides of the invention may be directed against antigenic site II (also referred to as site A) of the RSV F protein as well as against at least one other antigenic determinant, epitope, part or domain on the RSV F protein. In a preferred aspect, the polypeptides of the invention are directed against region aa 250-275 of the RSV F protein as well as against at least one other antigenic determinant, epitope, part or domain on the RSV F protein.

Generally, such a biparatopic (or multiparatopic) polypeptide of the invention will contain at least one NANOBODY® ($V_{HH}$ sequence) of the invention that is capable of binding to the Synagis® binding site on the RSV F protein and/or capable of competing with Synagis® for binding to the RSV F protein (and in particular against antigenic site II (also referred to as site A) of the RSV F protein and more preferably against region aa 250-275 of the RSV F protein), as well as at least one further NANOBODY® ($V_{HH}$ sequence) of the invention that is capable of binding to at least one other antigenic determinant, epitope, part or domain on the RSV F protein. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; and are preferably such that they can simultaneously bind the Synagis® binding site and the at least one other antigenic determinant, epitope, part or domain on the RSV F protein).

In another preferred, but non-limiting aspect, the polypeptides of the invention are biparatopic (or multiparatopic) and are directed against the 101F binding site on the RSV F protein and/or capable of competing with 101F for binding to the RSV F protein, as well as against at least one other antigenic determinant on the RSV F protein. The polypeptides of the invention may be directed against antigenic site IV-VI of the RSV F protein as well as against at least one other antigenic determinant on the RSV F protein. In a preferred aspect, the polypeptides of the invention are directed against region aa 423-436 of the RSV F protein as well as against at least one other antigenic determinant on the RSV F protein.

Generally, such a biparatopic (or multiparatopic) polypeptide of the invention will contain at least one NANOBODY® ($V_{HH}$ sequence) of the invention that is capable of binding to the 101F binding site on the RSV F protein and/or capable of competing with 101F for binding to the RSV F protein (and in particular against antigenic site IV-VI of the RSV F protein and more preferably against region aa 423-436 of the RSV F protein), as well as at least one further NANOBODY® ($V_{HH}$ sequence) of the invention that is capable of binding to at least one other antigenic determinant, epitope, part or domain on the RSV F protein. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the 101F binding site and the at least one other antigenic determinant, epitope, part or domain on the RSV F protein).

In another preferred, but non-limiting aspect, the polypeptides of the invention are biparatopic and are at least directed against the Synagis® binding site on the RSV F protein as well as against the 101F binding site on the RSV F protein. The polypeptides of the invention may be directed against antigenic site II (also referred to as site A) of the RSV F protein. The polypeptides of the invention may be directed against antigenic site IV-VI of the RSV F protein. The polypeptides of the invention may be directed against antigenic site II (also referred to as site A) of the RSV F protein as well as against antigenic site IV-VI of the RSV F protein. In a preferred aspect, the polypeptides of the invention are directed against region aa 250-275 of the RSV F protein. In another preferred aspect, the polypeptides of the invention are directed against region aa 250-275 of the RSV F protein as well as against region aa 423-436 of the RSV F protein. In another preferred aspect, the polypeptides of the invention are directed against region aa 423-436 of the RSV F protein. In another preferred aspect, the polypeptides of the invention are directed against antigenic site II (also referred to as site A) of the RSV F protein as well as against the region aa 423-436 of the RSV F protein. In another preferred aspect, the polypeptides of the invention are directed against region aa 250-275 of the RSV F protein as well as against antigenic site IV-VI of the RSV F protein.

Generally, such a biparatopic (or multiparatopic) polypeptide of the invention will contain at least one NANOBODY® ($V_{HH}$ sequence) of the invention that is capable of binding to the Synagis® binding site on the RSV F protein and/or capable of competing with Synagis® for binding to the RSV F protein (and in particular against antigenic site II (also referred to as site A) of the RSV F protein and more preferably against region aa 250-275 of the RSV F protein), as well as at least one NANOBODY® ($V_{HH}$ sequence) of the invention that is capable of binding to the 101F binding site on the RSV F protein and/or capable of competing with 101F for binding to the RSV F protein (and in particular against antigenic site IV-VI of the RSV F protein and more preferably against region aa 423-436 of the RSV F protein). Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; and are preferably such that they can simultaneously bind the Synagis® binding site and the 101F binding site on the RSV F protein).

In another preferred, but non-limiting aspect, the polypeptides of the invention are biparatopic (or multiparatopic) and are at least capable, upon binding to the RSV F protein, to neutralize a virus (as defined herein); to modulate, reduce and/or inhibit the infectivity of a virus (as defined herein); to modulate and in particular inhibit and/or prevent viral entry (as further defined herein) in a target host cell; and/or to modulate and in particular inhibit and/or prevent viral replication (as further defined herein) in a target host cell via the same mechanism of action as Synagis® and/or 101F.

In another preferred, but non-limiting aspect, the polypeptides of the invention are biparatopic with both paratopes directed against the Synagis® binding site on the RSV F protein. The polypeptides of the invention may be directed against antigenic site II (also referred to as site A) of the RSV F protein (one paratope or both paratopes). In a preferred aspect, the polypeptides of the invention are directed against region aa 250-275 of the RSV F protein (one paratope or both paratopes).

In another preferred, but non-limiting aspect, the polypeptides of the invention are biparatopic with both paratopes directed against the 101F binding site on the RSV F protein.

The polypeptides of the invention may be directed against antigenic site IV-VI of the RSV F protein (one paratope or both paratopes). In a preferred aspect, the polypeptides of the invention are directed against the region aa 423-436 of the RSV F protein (one paratope or both paratopes).

Again, the above biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; and are preferably such that they can simultaneously bind both binding sites).

In another preferred, but non-limiting aspect, the polypeptides of the invention are biparatopic (or multiparatopic) and are directed against the sialic acid binding site on the hemagglutinin H5 envelope protein of influenza virus and/or capable of competing with sialic acid for binding to the hemagglutinin H5 envelope protein of influenza virus, as well as against at least one other antigenic determinant, epitope, part or domain on the hemagglutinin H5 envelope protein of influenza virus.

Generally, such a biparatopic (or multiparatopic) polypeptide of the invention will contain at least one NANOBODY® ($V_{HH}$ sequence) of the invention that is capable of binding to the sialic acid binding site on the hemagglutinin H5 envelope protein of influenza virus and/or capable of competing with sialic acid for binding to the hemagglutinin H5 envelope protein of influenza virus, as well as at least one further NANOBODY® ($V_{HH}$ sequence) of the invention that is capable of binding to at least one other antigenic determinant, epitope, part or domain on the hemagglutinin H5 envelope protein of influenza virus. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; and are preferably such that they can simultaneously bind the sialic acid binding site and the at least one other antigenic determinant, epitope, part or domain on the hemagglutinin H5 envelope protein of influenza virus).

In another preferred, but non-limiting aspect, the polypeptides of the invention are biparatopic (or multiparatopic) and are directed against the VN04-2 binding site on the hemagglutinin H5 envelope protein of influenza virus and/or capable of competing with VN04-2 for binding to the hemagglutinin H5 envelope protein of influenza virus, as well as against at least one other antigenic determinant, epitope, part or domain on the hemagglutinin H5 envelope protein of influenza virus.

Generally, such a biparatopic (or multiparatopic) polypeptide of the invention will contain at least one NANOBODY® ($V_{HH}$ sequence) of the invention that is capable of binding to the VN04-2 binding site on the hemagglutinin H5 envelope protein of influenza virus and/or capable of competing with VN04-2 for binding to the hemagglutinin H5 envelope protein of influenza virus, as well as at least one further NANOBODY® ($V_{HH}$ sequence) of the invention that is capable of binding to at least one other antigenic determinant, epitope, part or domain on the hemagglutinin H5 envelope protein of influenza virus. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; and are preferably such that they can simultaneously bind the VN04-2 binding site and the at least one other antigenic determinant, epitope, part or domain on the hemagglutinin H5 envelope protein of influenza virus).

In another preferred, but non-limiting aspect, the polypeptides of the invention are biparatopic (or multiparatopic) and are at least capable, upon binding to the hemagglutinin H5 envelope protein of influenza virus, to neutralize a virus (as defined herein); to modulate, reduce and/or inhibit the infectivity of a virus (as defined herein); to modulate and in particular inhibit and/or prevent viral entry (as further defined herein) in a target host cell; and/or to modulate and in particular inhibit and/or prevent viral replication (as further defined herein) in a target host cell via the same mechanism of action as VN04-2.

In another preferred, but non-limiting aspect, the polypeptides of the invention are biparatopic (or multiparatopic) and are directed against the MAb C179 binding site on the hemagglutinin H5 envelope protein of influenza virus and/or capable of competing with MAb C179 for binding to the hemagglutinin H5 envelope protein of influenza virus, as well as against at least one other antigenic determinant, epitope, part or domain on the hemagglutinin H5 envelope protein of influenza virus.

Generally, such a biparatopic (or multiparatopic) polypeptide of the invention will contain at least one NANOBODY® ($V_{HH}$ sequence) of the invention that is capable of binding to the MAb C179 binding site on the hemagglutinin H5 envelope protein of influenza virus and/or capable of competing with MAb C179 for binding to the hemagglutinin H5 envelope protein of influenza virus, as well as at least one further NANOBODY® ($V_{HH}$ sequence) of the invention that is capable of binding to at least one other antigenic determinant, epitope, part or domain on the hemagglutinin H5 envelope protein of influenza virus. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; and are preferably such that they can simultaneously bind the MAb C179 binding site and the at least one other antigenic determinant, epitope, part or domain on the hemagglutinin H5 envelope protein of influenza virus).

In another preferred, but non-limiting aspect, the polypeptides of the invention are biparatopic (or multiparatopic) and are at least capable, upon binding to the hemagglutinin H5 envelope protein of influenza virus, to neutralize a virus (as defined herein); to modulate, reduce and/or inhibit the infectivity of a virus (as defined herein); to modulate and in particular inhibit and/or prevent viral entry (as further defined herein) in a target host cell; and/or to modulate and in particular inhibit and/or prevent viral replication (as further defined herein) in a target host cell via the same mechanism of action as MAb C179.

In another preferred, but non-limiting aspect, the polypeptides of the invention are biparatopic (or multiparatopic) and are directed against the MAb 8-2 binding site on the G envelope protein of rabies and/or capable of competing with MAb 8-2 for binding to the G envelope protein, as well as against at least one other antigenic determinant, epitope, part or domain on the G envelope protein.

Generally, such a biparatopic (or multiparatopic) polypeptide of the invention will contain at least one NANOBODY®

($V_{HH}$ sequence) of the invention that is capable of binding to the MAb 8-2 binding site on the G envelope protein and/or capable of competing with MAb 8-2 for binding to the G envelope protein, as well as at least one further NANOBODY® ($V_{HH}$ sequence) of the invention that is capable of binding to at least one other antigenic determinant, epitope, part or domain on the G envelope protein. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; and are preferably such that they can simultaneously bind the MAb 8-2 binding site and the at least one other antigenic determinant, epitope, part or domain on the G envelope protein).

In another preferred, but non-limiting aspect, the polypeptides of the invention are biparatopic (or multiparatopic) and are at least capable, upon binding to the G envelope protein, to neutralize a virus (as defined herein); to modulate, reduce and/or inhibit the infectivity of a virus (as defined herein); to modulate and in particular inhibit and/or prevent viral entry (as further defined herein) in a target host cell; and/or to modulate and in particular inhibit and/or prevent viral replication (as further defined herein) in a target host cell via the same mechanism of action as MAb 8-2.

In another preferred aspect, the polypeptides of the invention are capable of binding to three (different) antigenic determinants, epitopes, parts, domains of an envelope protein of a virus. In this context, the polypeptides of the invention are also referred to as "trivalent" (such as e.g. "trivalent triparatopic" or "trivalent biparatopic", "trivalent monoparatopic", etc.) amino acid sequences and polypeptides. The trivalent polypeptides of the invention can be directed against any antigenic determinants, epitopes, parts, and/or domains of the envelope protein of the virus.

For example, and generally, a trivalent polypeptide of the invention may comprise three NANOBODIES® ($V_{HH}$ sequences) of the invention directed against the same antigenic determinant, epitope, part or domain of the viral envelope protein (in which NANOBODIES® ($V_{HH}$ sequences) may be suitably linked, for example via a suitable linker as further described herein). A trivalent polypeptide of the invention may comprise two NANOBODIES® ($V_{HH}$ sequences) of the invention directed against a first antigenic determinant, epitope, part or domain of the viral envelope protein, and at least one NANOBODY® ($V_{HH}$ sequence) of the invention directed against a second antigenic determinant, epitope, part or domain of the viral envelope protein different from the first antigenic determinant, epitope, part or domain (in which said NANOBODIES® ($V_{HH}$ sequences) may be suitably linked, for example via a suitable linker as further described herein). Such a trivalent polypeptide of the invention may also be referred to as "trivalent biparatopic". A trivalent polypeptide of the invention may comprise one NANOBODY® ($V_{HH}$ sequence) of the invention directed against a first antigenic determinant, epitope, part or domain of the viral envelope protein, at least one NANOBODY® ($V_{HH}$ sequence) of the invention directed against a second antigenic determinant, epitope, part or domain of the viral envelope protein different from the first antigenic determinant, epitope, part or domain and at least one NANOBODY® ($V_{HH}$ sequence) of the invention directed against a third antigenic determinant, epitope, part or domain of the viral envelope protein different from the first and the second antigenic determinant, epitope, part or domain (in which said NANOBODIES® ($V_{HH}$ sequences) may be suitably linked, for example via a suitable linker as further described herein). Such a trivalent polypeptide of the invention may also be referred to as "trivalent triparatopic". A trivalent polypeptide of the invention may comprise two NANOBODIES® ($V_{HH}$ sequences) of the invention directed against a first antigenic determinant, epitope, part or domain of the viral envelope protein, and at least one NANOBODY® ($V_{HH}$ sequence) of the invention directed against a second antigenic determinant, epitope, part or domain of a viral envelope protein different from the first viral envelope protein. Such a trivalent polypeptide of the invention may also be referred to as "trivalent bispecific". A trivalent polypeptide of the invention may also comprise one NANOBODY® ($V_{HH}$ sequence) of the invention directed against a first antigenic determinant, epitope, part or domain of the viral envelope protein, at least one NANOBODY® ($V_{HH}$ sequence) of the invention directed against a second antigenic determinant, epitope, part or domain of the same viral envelope protein different from the first antigenic determinant, epitope, part or domain and at least one NANOBODY® ($V_{HH}$ sequence) of the invention directed against a third antigenic determinant, epitope, part or domain of a viral envelope protein different from the first viral envelope protein (in which said NANOBODIES® ($V_{HH}$ sequences) may be suitably linked, for example via a suitable linker as further described herein). Such a trivalent polypeptide of the invention may also be referred to as "trivalent trispecific". A trivalent polypeptide of the invention may also comprise one NANOBODY® ($V_{HH}$ sequence) of the invention directed against a first antigenic determinant, epitope, part or domain of the viral envelope protein, at least one NANOBODY® ($V_{HH}$ sequence) of the invention directed against a second antigenic determinant, epitope, part or domain of a viral envelope protein different from the first viral envelope protein and at least one NANOBODY® ($V_{HH}$ sequence) of the invention directed against a third antigenic determinant, epitope, part or domain of a viral envelope protein different from the first and the second viral envelope protein (in which said NANOBODIES® ($V_{HH}$ sequences) may be suitably linked, for example via a suitable linker as further described herein). Such a trivalent polypeptide of the invention may also be referred to as "trivalent trispecific".

Preferably, such a trivalent polypeptide of the invention is further such that, when it binds to the viral envelope protein, it is capable of simultaneously binding to the first antigenic determinant, epitope, part or domain (i.e. via the at least one NANOBODY® ($V_{HH}$ sequence) of the invention capable of binding to said first antigenic determinant, epitope, part or domain), binding to said second antigenic determinant, epitope, part or domain (i.e. via the at least one NANOBODY® ($V_{HH}$ sequence) of the invention capable of binding to said second antigenic determinant, epitope, part or domain) and binding to said third antigenic determinant, epitope, part or domain (i.e. via the at least one NANOBODY® ($V_{HH}$ sequence) of the invention capable of binding to said third antigenic determinant, epitope, part or domain). Examples of such trivalent polypeptides of the invention will become clear from the further description herein. Generally, such trivalent polypeptides of the invention may be as further described herein.

In a preferred, but non-limiting aspect, the polypeptides of the invention are trivalent and comprise one NANOBODY® ($V_{HH}$ sequence) of the invention directed against the Synagis® binding site on the RSV F protein and/or capable of competing with Synagis for binding to the RSV F protein, as well as two NANOBODIES® ($V_{HH}$ sequences) of the invention directed against another antigenic determinant, epitope, part or domain on the RSV F protein. The polypeptides of the invention that are directed against the Synagis® binding site on the RSV F protein may be directed against antigenic site II (also referred to as site A) of the RSV F protein. In a preferred aspect, the polypeptides of the invention that are directed against the Synagis® binding site on the RSV F protein are directed against region aa 250-275 of the RSV F protein. Generally, such a trivalent polypeptide of the invention will contain at least one NANOBODY® ($V_{HH}$ sequence) of the invention that is capable of binding to the Synagis® binding site on the RSV F protein and/or capable of competing with Synagis® for binding to the RSV F protein (and in particular against antigenic site II (also referred to as site A) of the RSV F protein and more preferably against region aa 250-275 of the RSV F protein), as well as two further NANOBODIES® ($V_{HH}$ sequences) of the invention that are capable of binding to two other antigenic determinants, epitopes, parts or domains on the RSV F protein. Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; and are preferably such that they can simultaneously bind the Synagis® binding site and the two other antigenic determinants, epitopes, parts or domains on the RSV F protein).

In another preferred, but non-limiting aspect, the polypeptides of the invention are trivalent and comprise two NANOBODIES® ($V_{HH}$ sequences) of the invention directed against the Synagis® binding site on the RSV F protein and/or capable of competing with Synagis for binding to the RSV F protein, as well as one NANOBODY® ($V_{HH}$ sequence) of the invention directed against another antigenic determinant, epitope, part or domain on the RSV F protein. The polypeptides of the invention that are directed against the Synagis® binding site on the RSV F protein may be directed against antigenic site II (also referred to as site A) of the RSV F protein. In a preferred aspect, the polypeptides of the invention that are directed against the Synagis® binding site on the RSV F protein are directed against region aa 250-275 of the RSV F protein. Generally, such a trivalent polypeptide of the invention will contain two NANOBODIES® ($V_{HH}$ sequences) of the invention that are capable of binding to the Synagis® binding site on the RSV F protein and/or capable of competing with Synagis® for binding to the RSV F protein (and in particular against antigenic site II (also referred to as site A) of the RSV F protein and more preferably against region aa 250-275 of the RSV F protein), as well as one further NANOBODY® ($V_{HH}$ sequence) of the invention that is capable of binding to another antigenic determinant, epitope, part or domain on the RSV F protein. Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; and are preferably such that they can simultaneously bind the Synagis® binding site and the other antigenic determinant, epitope, part or domain on the RSV F protein).

In another preferred, but non-limiting aspect, the polypeptides of the invention are trivalent and comprise three NANOBODIES® ($V_{HH}$ sequences) of the invention directed against the Synagis® binding site on the RSV F protein and/or capable of competing with Synagis for binding to the RSV F protein. The polypeptides of the invention that are directed against the Synagis® binding site on the RSV F protein may be directed against antigenic site II (also referred to as site A) of the RSV F protein. In a preferred aspect, the polypeptides of the invention that are directed against the Synagis® binding site on the RSV F protein are directed against region aa 250-275 of the RSV F protein. Generally, such a trivalent polypeptide of the invention will contain three NANOBODIES® ($V_{HH}$ sequences) of the invention that are capable of binding to the Synagis® binding site on the RSV F protein and/or capable of competing with Synagis® for binding to the RSV F protein (and in particular against antigenic site II (also referred to as site A) of the RSV F protein and more preferably against region aa 250-275 of the RSV F protein). Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; and are preferably such that they can simultaneously bind the Synagis® binding site).

In another preferred, but non-limiting aspect, the polypeptides of the invention are trivalent and are at least capable, upon binding to the RSV F protein, to neutralize a virus (as defined herein); to modulate, reduce and/or inhibit the infectivity of a virus (as defined herein); to modulate and in particular inhibit and/or prevent viral entry (as further defined herein) in a target host cell; and/or to modulate and in particular inhibit and/or prevent viral replication (as further defined herein) in a target host cell via the same mechanism of action as Synagis®.

In a preferred, but non-limiting aspect, the polypeptides of the invention are trivalent and comprise one NANOBODY® ($V_{HH}$ sequence) of the invention directed against the 101F binding site on the RSV F protein and/or capable of competing with 101F for binding to the RSV F protein, as well as two NANOBODIES® ($V_{HH}$ sequences) of the invention directed against another antigenic determinant, epitope, part or domain on the RSV F protein. The polypeptides of the invention that are directed against the 101F binding site on the RSV F protein may be directed against antigenic site IV-VI of the RSV F protein. In a preferred aspect, the polypeptides of the invention that are directed against the 101F binding site on the RSV F protein are directed against region aa 423-436 of the RSV F protein. Generally, such a trivalent polypeptide of the invention will contain at least one NANOBODY® ($V_{HH}$ sequence) of the invention that is capable of binding to the 101F binding site on the RSV F protein and/or capable of competing with 101F for binding to the RSV F protein (and in particular against antigenic site IV-VI of the RSV F protein and more preferably against region aa 423-436 of the RSV F protein), as well as two further NANOBODIES® ($V_{HH}$ sequences) of the invention that are capable of binding to two other antigenic determinants, epitopes, parts or domains on the RSV F protein. Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; and are preferably such that they can simultaneously bind the 101F binding site and the two other antigenic determinants, epitopes, parts or domains on the RSV F protein).

In another preferred, but non-limiting aspect, the polypeptides of the invention are trivalent and comprise two NANOBODIES® ($V_{HH}$ sequences) of the invention directed against the 101F binding site on the RSV F protein and/or capable of competing with 101F for binding to the RSV F protein, as well as one NANOBODY® ($V_{HH}$ sequence) of the invention directed against another antigenic determinant, epitope, part or domain on the RSV F protein. The polypeptides of the invention that are directed against the 101F binding site on the RSV F protein may be directed against antigenic site IV-VI of the RSV F protein. In a preferred aspect, the polypeptides of the invention that are directed against the 101F binding site on the RSV F protein are directed against region aa 423-436 of the RSV F protein. Generally, such a trivalent polypeptide of the invention will contain two NANOBODIES® ($V_{HH}$ sequences) of the invention that are capable of binding to the 101F binding site on the RSV F protein and/or capable of competing with 101F for binding to the RSV F protein (and in particular against antigenic site IV-VI of the RSV F protein and more preferably against region aa 423-436 of the RSV F protein), as well as one further NANOBODY® ($V_{HH}$ sequence) of the invention that is capable of binding to another antigenic determinant, epitope, part or domain on the RSV F protein. Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; and are preferably such that they can simultaneously bind the 101F binding site and the other antigenic determinant, epitope, part or domain on the RSV F protein).

In another preferred, but non-limiting aspect, the polypeptides of the invention are trivalent and comprise three NANOBODIES® ($V_{HH}$ sequences) of the invention directed against the 101F binding site on the RSV F protein and/or capable of competing with 101F for binding to the RSV F protein. polypeptides of the invention that are directed against the 101F binding site on the RSV F protein may be directed against antigenic site IV-VI of the RSV F protein. In a preferred aspect, the polypeptides of the invention that are directed against the 101F binding site on the RSV F protein are directed against region aa 423-436 of the RSV F protein. Generally, such a trivalent polypeptide of the invention will contain three NANOBODIES® ($V_{HH}$ sequences) of the invention that are capable of binding to the 101F binding site on the RSV F protein and/or capable of competing with 101F for binding to the RSV F protein (and in particular against antigenic site IV-VI of the RSV F protein and more preferably against region aa 423-436 of the RSV F protein). Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; and are preferably such that they can simultaneously bind the 101F binding site).

In another preferred, but non-limiting aspect, the polypeptides of the invention are trivalent and are at least capable, upon binding to the RSV F protein, to neutralize a virus (as defined herein); to modulate, reduce and/or inhibit the infectivity of a virus (as defined herein); to modulate and in particular inhibit and/or prevent viral entry (as further defined herein) in a target host cell; and/or to modulate and in particular inhibit and/or prevent viral replication (as further defined herein) in a target host cell via the same mechanism of action as 101F.

In another preferred, but non-limiting aspect, the polypeptides of the invention are trivalent and comprise two NANOBODIES® ($V_{HH}$ sequences) of the invention directed against the Synagis® binding site on the RSV F protein and/or capable of competing with Synagis for binding to the RSV F protein, as well as one NANOBODY® ($V_{HH}$ sequence) of the invention directed against the 101F binding site on the RSV F protein and/or capable of competing with 101F for binding to the RSV F protein. The NANOBODIES® ($V_{HH}$ sequences) of the invention that are directed against the Synagis® binding site on the RSV F protein may be directed against antigenic site II (also referred to as site A) of the RSV F protein. In a preferred aspect, the NANOBODIES® ($V_{HH}$ sequences) of the invention that are directed against the Synagis® binding site on the RSV F protein are directed against region aa 250-275 of the RSV F protein. The NANOBODIES® ($V_{HH}$ sequences) of the invention that are directed against the 101F binding site on the RSV F protein may be directed against antigenic site IV-VI of the RSV F protein. In a preferred aspect, NANOBODIES® ($V_{HH}$ sequences) of the invention that are directed against the 101F binding site on the RSV F protein are directed against region aa 423-436 of the RSV F protein. Generally, such a trivalent polypeptide of the invention will contain two NANOBODIES® ($V_{HH}$ sequences) of the invention that are capable of binding to the Synagis® binding site on the RSV F protein and/or capable of competing with Synagis® for binding to the RSV F protein (and in particular against antigenic site II (also referred to as site A) of the RSV F protein and more preferably against region aa 250-275 of the RSV F protein), as well as one further NANOBODY® ($V_{HH}$ sequence) of the invention that is capable of binding to the 101F binding site on the RSV F protein and/or capable of competing with 101F for binding to the RSV F protein (and in particular against antigenic site IV-VI of the RSV F protein and more preferably against region aa 423-436 of the RSV F protein). Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; and are preferably such that they can simultaneously bind the Synagis® binding site and the 101F binding site on the RSV F protein).

In another preferred, but non-limiting aspect, the polypeptides of the invention are trivalent and comprise one NANOBODY® ($V_{HH}$ sequence) of the invention directed against the Synagis® binding site on the RSV F protein and/or capable of competing with Synagis for binding to the RSV F protein, as well as two NANOBODIES® ($V_{HH}$ sequences) of the invention directed against the 101F binding site on the RSV F protein and/or capable of competing with 101F for binding to the RSV F protein. The NANOBODIES® ($V_{HH}$ sequences) of the invention that are directed against the Synagis® binding site on the RSV F protein may be directed against antigenic site II (also referred to as site A) of the RSV F protein. In a preferred aspect, the NANOBODIES® ($V_{HH}$ sequences) of the invention that are directed against the Synagis® binding site on the RSV F protein are directed against region aa 250-275 of the RSV F protein. The NANOBODIES® ($V_{HH}$ sequences) of the invention that are directed against the 101F binding site on the RSV F protein may be directed against antigenic site IV-VI of the RSV F protein. In a preferred aspect, the NANOBODIES® ($V_{HH}$ sequences) of the invention that are directed against the 101F binding site on the RSV F protein are directed against region aa 423-436 of the RSV F protein. Generally, such a trivalent polypeptide of the invention will contain one NANOBODY® ($V_{HH}$ sequence) of the invention that is capable of binding to the Synagis® binding site on the RSV F protein and/or capable of competing with Synagis® for binding to the RSV F protein (and in particular against antigenic site II (also referred to as site A) of the RSV F protein and more preferably against region aa 250-275 of the RSV F protein), as well as two further NANOBODIES® ($V_{HH}$ sequences) of the invention that are capable of binding to the 101F binding site on the RSV F protein and/or capable of competing with 101F for binding to the RSV F protein (and in particular against antigenic site IV-VI of the RSV F protein and more preferably against region aa 423-436 of the RSV F protein). Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; and are preferably such that they can simultaneously bind the Synagis® binding site and the 101F binding site on the RSV F protein).

In another preferred, but non-limiting aspect, the polypeptides of the invention are trivalent and comprise one NANOBODY® ($V_{HH}$ sequence) of the invention directed against the Synagis® binding site on the RSV F protein and/or capable of competing with Synagis for binding to the RSV F protein, one NANOBODY® ($V_{HH}$ sequence) of the invention directed against the 101F binding site on the RSV F protein and/or capable of competing with 101F for binding to the RSV F protein, as well as one NANOBODY® ($V_{HH}$ sequence) of the invention directed against another antigenic determinant, epitope, part or domain on the RSV F protein. The NANOBODY® ($V_{HH}$ sequence) of the invention that is directed against the Synagis® binding site on the RSV F protein may be directed against antigenic site II (also referred to as site A) of the RSV F protein. In a preferred aspect, the NANOBODY® ($V_{HH}$ sequence) of the invention that is directed against the Synagis® binding site on the RSV F protein may be directed against region aa 250-275 of the RSV F protein. The NANOBODY® ($V_{HH}$ sequence) of the invention that is directed against the 101F binding site on the RSV F protein may be directed against antigenic site IV-VI of the RSV F protein. In a preferred aspect, the NANOBODY® ($V_{HH}$ sequence) of the invention that is directed against the 101F binding site on the RSV F protein may be directed against region aa 423-436 of the RSV F protein. Generally, such a trivalent polypeptide of the invention will contain one NANOBODY® ($V_{HH}$ sequence) of the invention that is capable of binding to the Synagis® binding site on the RSV F protein and/or capable of competing with Synagis® for binding to the RSV F protein (and in particular against antigenic site II (also referred to as site A) of the RSV F protein and more preferably against region aa 250-275 of the RSV F protein), one further NANOBODY® ($V_{HH}$ sequence) of the invention that is capable of binding to the 101F binding site on the RSV F protein and/or capable of competing with 101F for binding to the RSV F protein (and in particular against antigenic site IV-VI of the RSV F protein and more preferably against region aa 423-436 of the RSV F protein), as well as one further NANOBODY® ($V_{HH}$ sequence) of the invention directed against another antigenic determinant, epitope, part or domain on the RSV F protein. Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; and are preferably such that they can simultaneously bind the Synagis® binding site, the 101F binding site and the other antigenic determinant, epitope, part or domain on the RSV F protein).

In another preferred, but non-limiting aspect, the polypeptides of the invention are trivalent and are at least capable, upon binding to the RSV F protein, to neutralize a virus (as defined herein); to modulate, reduce and/or inhibit the infectivity of a virus (as defined herein); to modulate and in particular inhibit and/or prevent viral entry (as further defined herein) in a target host cell; and/or to modulate and in particular inhibit and/or prevent viral replication (as further defined herein) in a target host cell via the same mechanism of action as Synagis® and/or 101F.

In a preferred, but non-limiting aspect, the polypeptides of the invention are trivalent and comprise one NANOBODY® ($V_{HH}$ sequence) of the invention directed against the sialic acid binding site on the hemagglutinin H5 envelope protein of influenza virus and/or capable of competing with sialic acid for binding to the hemagglutinin H5 envelope protein of influenza virus, as well as two NANOBODIES® ($V_{HH}$ sequences) of the invention directed against another antigenic determinant, epitope, part or domain on the hemagglutinin H5 envelope protein of influenza virus. Generally, such a trivalent polypeptide of the invention will contain at least one NANOBODY® ($V_{HH}$ sequence) of the invention that is capable of binding to the sialic acid binding site on the hemagglutinin H5 envelope protein of influenza virus and/or capable of competing with sialic acid for binding to the hemagglutinin H5 envelope protein of influenza virus, as well as two further NANOBODIES® ($V_{HH}$ sequences) of the invention that are capable of binding to two other antigenic determinants, epitopes, parts or domains on the hemagglutinin H5 envelope protein of influenza virus. Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; and are preferably such that they can simultaneously bind the sialic acid binding site and the two other antigenic determinants, epitopes, parts or domains on the hemagglutinin H5 envelope protein of influenza virus).

In another preferred, but non-limiting aspect, the polypeptides of the invention are trivalent and comprise two NANOBODIES® ($V_{HH}$ sequences) of the invention directed against the sialic acid binding site on the hemagglutinin H5 envelope protein of influenza virus and/or capable of competing with sialic acid for binding to the hemagglutinin H5 envelope protein of influenza virus, as well as one NANOBODY® ($V_{HH}$ sequence) of the invention directed against another antigenic determinant, epitope, part or domain on the hemagglutinin H5 envelope protein of influenza virus. Generally, such a trivalent polypeptide of the invention will contain two NANOBODIES® ($V_{HH}$ sequences) of the invention that are capable of binding to the sialic acid binding site on the hemagglutinin H5 envelope protein of influenza virus and/or capable of competing with sialic acid for binding to the hemagglutinin H5 envelope protein of influenza virus, as well as one further NANOBODY® ($V_{HH}$ sequence) of the invention that is capable of binding to another antigenic determinant, epitope, part or domain on the hemagglutinin H5 envelope protein of influenza virus. Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; and are preferably such that they can simultaneously bind the sialic acid binding site and the other antigenic determinant, epitope, part or domain on the hemagglutinin H5 envelope protein of influenza virus).

In another preferred, but non-limiting aspect, the polypeptides of the invention are trivalent and comprise three NANOBODIES® ($V_{HH}$ sequences) of the invention directed against the sialic acid binding site on the hemagglutinin H5 envelope protein of influenza virus and/or capable of competing with sialic acid for binding to the hemagglutinin H5 envelope protein of influenza virus. Generally, such a trivalent polypeptide of the invention will contain three NANOBODIES® ($V_{HH}$ sequences) of the invention that are capable of binding to the sialic acid binding site on the hemagglutinin H5 envelope protein of influenza virus and/or capable of competing with sialic acid for binding to the hemagglutinin H5 envelope protein of influenza virus. Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; and are preferably such that they can simultaneously bind the sialic acid binding site).

In a preferred, but non-limiting aspect, the polypeptides of the invention are trivalent and comprise one NANOBODY® ($V_{HH}$ sequence) of the invention directed against the VN04-2 binding site on the hemagglutinin H5 envelope protein of influenza virus and/or capable of competing with VN04-2 for binding to the hemagglutinin H5 envelope protein of influenza virus, as well as two NANOBODIES® ($V_{HH}$ sequences) of the invention directed against another antigenic determinant, epitope, part or domain on the hemagglutinin H5 envelope protein of influenza virus. Generally, such a trivalent polypeptide of the invention will contain at least one NANOBODY® ($V_{HH}$ sequence) of the invention that is capable of binding to the VN04-2 binding site on the hemagglutinin H5 envelope protein of influenza virus and/or capable of competing with VN04-2 for binding to the hemagglutinin H5 envelope protein of influenza virus, as well as two further NANOBODIES® ($V_{HH}$ sequences) of the invention that are capable of binding to two other antigenic determinants, epitopes, parts or domains on the hemagglutinin H5 envelope protein of influenza virus. Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; and are preferably such that they can simultaneously bind the VN04-2 binding site and the two other antigenic determinants, epitopes, parts or domains on the hemagglutinin H5 envelope protein of influenza virus).

In another preferred, but non-limiting aspect, the polypeptides of the invention are trivalent and comprise two NANOBODIES® ($V_{HH}$ sequences) of the invention directed against the VN04-2 binding site on the hemagglutinin H5 envelope protein of influenza virus and/or capable of competing with VN04-2 for binding to the hemagglutinin H5 envelope protein of influenza virus, as well as one NANOBODY® ($V_{HH}$ sequence) of the invention directed against another antigenic determinant, epitope, part or domain on the hemagglutinin H5 envelope protein of influenza virus. Generally, such a trivalent polypeptide of the invention will contain two NANOBODIES® ($V_{HH}$ sequences) of the invention that are capable of binding to the VN04-2 binding site on the hemagglutinin H5 envelope protein of influenza virus and/or capable of competing with VN04-2 for binding to the hemagglutinin H5 envelope protein of influenza virus, as well as one further NANOBODY® ($V_{HH}$ sequence) of the invention that is capable of binding to another antigenic determinant, epitope, part or domain on the hemagglutinin H5 envelope protein of influenza virus. Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; and are preferably such that they can simultaneously bind the VN04-2 binding site and the other antigenic determinant, epitope, part or domain on the hemagglutinin H5 envelope protein of influenza virus).

In another preferred, but non-limiting aspect, the polypeptides of the invention are trivalent and comprise three NANOBODIES® ($V_{HH}$ sequences) of the invention directed against the VN04-2 binding site on the hemagglutinin H5 envelope protein of influenza virus and/or capable of competing with VN04-2 for binding to the hemagglutinin H5 envelope protein of influenza virus. Generally, such a trivalent polypeptide of the invention will contain three NANOBODIES® ($V_{HH}$ sequences) of the invention that are capable of binding to the VN04-2 binding site on the hemagglutinin H5 envelope protein of influenza virus and/or capable of competing with VN04-2 for binding to the hemagglutinin H5 envelope protein of influenza virus. Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; and are preferably such that they can simultaneously bind the VN04-2 binding site).

In another preferred, but non-limiting aspect, the amino acid sequences and (in particular) polypeptides of the invention are trivalent and are at least capable, upon binding to the hemagglutinin H5 envelope protein of influenza virus, to neutralize a virus (as defined herein); to modulate, reduce and/or inhibit the infectivity of a virus (as defined herein); to modulate and in particular inhibit and/or prevent viral entry (as further defined herein) in a target host cell; and/or to modulate and in particular inhibit and/or prevent viral replication (as further defined herein) in a target host cell via the same mechanism of action as VN04-2.

In a preferred, but non-limiting aspect, the polypeptides of the invention are trivalent and comprise one NANOBODY® ($V_{HH}$ sequence) of the invention directed against the MAb C179 binding site on the hemagglutinin H5 envelope protein of influenza virus and/or capable of competing with MAb C179 for binding to the hemagglutinin H5 envelope protein of influenza virus, as well as two NANOBODIES® ($V_{HH}$ sequences) of the invention directed against another antigenic determinant, epitope, part or domain on the hemagglutinin H5 envelope protein of influenza virus. Generally, such a trivalent polypeptide of the invention will contain at least one NANOBODY® ($V_{HH}$ sequence) of the invention that is capable of binding to the MAb C179 binding site on the hemagglutinin H5 envelope protein of influenza virus and/or capable of competing with MAb C179 for binding to the hemagglutinin H5 envelope protein of influenza virus, as well as two further NANOBODIES® ($V_{HH}$ sequences) of the invention that are capable of binding to two other antigenic determinants, epitopes, parts or domains on the hemagglutinin H5 envelope protein of influenza virus. Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; and are preferably such that they can simultaneously bind the MAb C179 binding site and the two other antigenic determinants, epitopes, parts or domains on the hemagglutinin H5 envelope protein of influenza virus).

In another preferred, but non-limiting aspect, the polypeptides of the invention are trivalent and comprise two NANOBODIES® ($V_{HH}$ sequences) of the invention directed against the MAb C179 binding site on the hemagglutinin H5 envelope protein of influenza virus and/or capable of competing with MAb C179 for binding to the hemagglutinin H5 envelope protein of influenza virus, as well as one NANOBODY® ($V_{HH}$ sequence) of the invention directed against another antigenic determinant, epitope, part or domain on the hemagglutinin H5 envelope protein of influenza virus. Generally, such a trivalent polypeptide of the invention will contain two NANOBODIES® ($V_{HH}$ sequences) of the invention that are capable of binding to the MAb C179 binding site on the hemagglutinin H5 envelope protein of influenza virus and/or capable of competing with MAb C179 for binding to the hemagglutinin H5 envelope protein of influenza virus, as well as one further NANOBODY® ($V_{HH}$ sequence) of the invention that is capable of binding to another antigenic determinant, epitope, part or domain on the hemagglutinin H5 envelope protein of influenza virus. Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; and are preferably such that they can simultaneously bind the MAb C179 binding site and the other antigenic determinant, epitope, part or domain on the hemagglutinin H5 envelope protein of influenza virus).

In another preferred, but non-limiting aspect, the polypeptides of the invention are trivalent and comprise three NANOBODIES® ($V_{HH}$ sequences) of the invention directed against the MAb C179 binding site on the hemagglutinin H5 envelope protein of influenza virus and/or capable of competing with MAb C179 for binding to the hemagglutinin H5 envelope protein of influenza virus. Generally, such a trivalent polypeptide of the invention will contain three NANOBODIES® ($V_{HH}$ sequences) of the invention that are capable of binding to the MAb C179 binding site on the hemagglutinin H5 envelope protein of influenza virus and/or capable of competing with MAb C179 for binding to the hemagglutinin H5 envelope protein of influenza virus. Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; and are preferably such that they can simultaneously bind the MAb C179 binding site).

In another preferred, but non-limiting aspect, the amino acid sequences and (in particular) polypeptides of the invention are trivalent and are at least capable, upon binding to the hemagglutinin H5 envelope protein of influenza virus, to neutralize a virus (as defined herein); to modulate, reduce and/or inhibit the infectivity of a virus (as defined herein); to modulate and in particular inhibit and/or prevent viral entry (as further defined herein) in a target host cell; and/or to modulate and in particular inhibit and/or prevent viral replication (as further defined herein) in a target host cell via the same mechanism of action as MAb C179.

In a preferred, but non-limiting aspect, the polypeptides of the invention are trivalent and comprise one NANOBODY® ($V_{HH}$ sequence) of the invention directed against the MAb 8-2 binding site on the G envelope protein of rabies and/or capable of competing with MAb 8-2 for binding to the G envelope protein, as well as two NANOBODIES® ($V_{HH}$ sequences) of the invention directed against another antigenic determinant, epitope, part or domain on the G envelope protein. Generally, such a trivalent polypeptide of the invention will contain at least one NANOBODY® ($V_{HH}$ sequence) of the invention that is capable of binding to the MAb 8-2 binding site on the G envelope protein and/or capable of competing with MAb 8-2 for binding to the G envelope protein, as well as two further NANOBODIES® ($V_{HH}$ sequences) of the invention that are capable of binding to two other antigenic determinants, epitopes, parts or domains on the G envelope protein. Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; and are preferably such that they can simultaneously bind the MAb 8-2 binding site and the two other antigenic determinants, epitopes, parts or domains on the G envelope protein).

In another preferred, but non-limiting aspect, the polypeptides of the invention are trivalent and comprise two NANOBODIES® ($V_{HH}$ sequences) of the invention directed against the MAb 8-2 binding site on the G envelope protein and/or capable of competing with MAb 8-2 for binding to the G envelope protein, as well as NANOBODY® ($V_{HH}$ sequence) of the invention directed against another antigenic determinant, epitope, part or domain on the G envelope protein. Generally, such a trivalent polypeptide of the invention will contain two NANOBODIES® ($V_{HH}$ sequences) of the invention that are capable of binding to the MAb 8-2 binding site on the G envelope protein and/or capable of competing with MAb 8-2 for binding to the G envelope protein, as well as one further NANOBODY® ($V_{HH}$ sequence) of the invention that is capable of binding to another antigenic determinant, epitope, part or domain on the G envelope protein. Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; and are preferably such that they can simultaneously bind the MAb 8-2 binding site and the other antigenic determinant, epitope, part or domain on the G envelope protein).

In another preferred, but non-limiting aspect, the polypeptides of the invention are trivalent and comprise three NANOBODIES® ($V_{HH}$ sequences) of the invention directed against the MAb 8-2 binding site on the G envelope protein and/or capable of competing with MAb 8-2 for binding to the G envelope protein. Generally, such a trivalent polypeptide of the invention will contain three NANOBODIES® ($V_{HH}$ sequences) of the invention that are capable of binding to the MAb 8-2 binding site on the G envelope protein and/or capable of competing with MAb 8-2 for binding to the G envelope protein. Generally, such trivalent polypeptides of the invention may be as further described herein, and the various preferred aspects of the invention as described herein also apply to these trivalent polypeptides of the invention (for example, these trivalent polypeptides of the invention may comprise suitable linkers; and are preferably such that they can simultaneously bind the MAb 8-2 binding site).

In another preferred, but non-limiting aspect, the polypeptides of the invention are trivalent and are at least capable, upon binding to the G envelope protein of rabies, to neutralize a virus (as defined herein); to modulate, reduce and/or inhibit the infectivity of a virus (as defined herein); to modulate and in particular inhibit and/or prevent viral entry (as further defined herein) in a target host cell; and/or to modulate and in particular inhibit and/or prevent viral replication (as further defined herein) in a target host cell via the same mechanism of action as MAb 8-2.

Preferred bivalent and trivalent polypeptides of the invention are given in Tables C-6, Table A-2, Table A-4, Table A-5, Table A-6, Table A-9 and Table A-10.

Preferred, but non-limiting examples of multivalent (bivalent and trivalent) NANOBODY® ($V_{HH}$ sequence) constructs are the polypeptides of SEQ ID NO's: 2382 to 2415, 2423 to 2430, 2641 to 2659, 2663 to 2681, 2978 to 2998, 3016 to 3056 and 3584 to 3591.

According to another specific, but non-limiting aspect, a polypeptide of the invention comprises or essentially consists of at least one NANOBODY® ($V_{HH}$ sequence) of the invention and at least one other binding unit (i.e. directed against another epitope, antigen, target, protein or polypeptide), which is preferably also a NANOBODY® ($V_{HH}$ sequence). Such proteins or polypeptides are also referred to herein as "multispecific" proteins or polypeptides or as "multispecific constructs", and these may provide certain advantages compared to the corresponding monovalent NANOBODIES® ($V_{HH}$ sequences) of the invention (as will become clear from the further discussion herein of some preferred, but-nonlimiting multispecific constructs).

According to yet another specific, but non-limiting aspect, a polypeptide of the invention comprises or essentially consists of at least one NANOBODY® ($V_{HH}$ sequence) of the invention, optionally one or more further NANOBODIES® ($V_{HH}$ sequences), and at least one other amino acid sequence (such as a protein or polypeptide) that confers at least one desired property to the NANOBODY® ($V_{HH}$ sequence) of the invention and/or to the resulting fusion protein. Again, such fusion proteins may provide certain advantages compared to the corresponding monovalent NANOBODIES® ($V_{HH}$ sequences) of the invention. Some non-limiting examples of such amino acid sequences and of such fusion constructs will become clear from the further description herein.

It is also possible to combine two or more of the above aspects, for example to provide a trivalent bispecific construct comprising two NANOBODIES® ($V_{HH}$ sequences) of the invention and one other NANOBODY® ($V_{HH}$ sequence), and optionally one or more other amino acid sequences. Further non-limiting examples of such constructs, as well as some constructs that are particularly preferred within the context of the present invention, will become clear from the further description herein.

In the above constructs, the one or more NANOBODIES® ($V_{HH}$ sequences) and/or other amino acid sequences may be directly linked to each other and/or suitably linked to each other via one or more linker sequences. Some suitable but non-limiting examples of such linkers will become clear from the further description herein.

In one specific aspect of the invention, a NANOBODY® ($V_{HH}$ sequence) of the invention or a compound, construct or polypeptide of the invention comprising at least one NANOBODY® ($V_{HH}$ sequence) of the invention may have an increased half-life, compared to the corresponding amino acid sequence or NANOBODY® ($V_{HH}$ sequence) of the invention. Some preferred, but non-limiting examples of such NANOBODIES® ($V_{HH}$ sequences), compounds and polypeptides will become clear to the skilled person based on the further disclosure herein, and for example comprise NANOBODIES® ($V_{HH}$ sequences) sequences or polypeptides of the invention that have been chemically modified to increase the half-life thereof (for example, by means of pegylation); amino acid sequences or NANOBODIES® ($V_{HH}$ sequences) of the invention that comprise at least one additional binding site for binding to a serum protein (such as serum albumin, see for example EP 0 368 684 B1, page 4); or polypeptides of the invention that comprise at least one NANOBODY® ($V_{HH}$ sequence) of the invention that is linked to at least one moiety (and in particular at least one amino acid sequence) that increases the half-life of the NANOBODY® ($V_{HH}$ sequence) of the invention. Examples of polypeptides of the invention that comprise such half-life extending moieties or amino acid sequences will become clear to the skilled person based on the further disclosure herein; and for example include, without limitation, polypeptides in which the one or more NANOBODIES® ($V_{HH}$ sequences) of the invention are suitable linked to one or more serum proteins or fragments thereof (such as serum albumin or suitable fragments thereof) or to one or more binding units that can bind to serum proteins (such as, for example, NANOBODIES® ($V_{HH}$ sequences) or (single) domain antibodies that can bind to serum proteins such as serum albumin, serum immunoglobulins such as IgG, or transferrin); polypeptides in which a NANOBODY® ($V_{HH}$ sequence) of the invention is linked to an Fc portion (such as a human Fc) or a suitable part or fragment thereof; or polypeptides in which the one or more NANOBODIES® ($V_{HH}$ sequences) of the invention are suitable linked to one or more small proteins or peptides that can bind to serum proteins (such as, without limitation, the proteins and peptides described in WO 91/01743, WO 01/45746, WO 02/076489 and WO 08/068280).

Again, as will be clear to the skilled person, such NANOBODIES® ($V_{HH}$ sequences), compounds, constructs or polypeptides may contain one or more additional groups, residues, moieties or binding units, such as one or more further amino acid sequences and in particular one or more additional NANOBODIES® ($V_{HH}$ sequences) (i.e. not directed against an envelope protein of a virus), so as to provide a tri- of multispecific NANOBODY® ($V_{HH}$ sequence) construct.

Generally, the NANOBODIES® ($V_{HH}$ sequences) of the invention (or compounds, constructs or polypeptides comprising the same) with increased half-life preferably have a half-life that is at least 1.5 times, preferably at least 2 times, such as at least 5 times, for example at least 10 times or more than 20 times, greater than the half-life of the corresponding NANOBODY® ($V_{HH}$ sequence) of the invention per se. For example, the NANOBODIES® ($V_{HH}$ sequences), compounds, constructs or polypeptides of the invention with increased half-life may have a half-life that is increased with more than 1 hours, preferably more than 2 hours, more preferably more than 6 hours, such as more than 12 hours, or even more than 24, 48 or 72 hours, compared to the corresponding NANOBODY® ($V_{HH}$ sequence) of the invention per se.

In a preferred, but non-limiting aspect of the invention, such NANOBODIES® ($V_{HH}$ sequences), compound, constructs or polypeptides of the invention exhibit a serum half-life in human of at least about 12 hours, preferably at least 24 hours, more preferably at least 48 hours, even more preferably at least 72 hours or more. For example, compounds or polypeptides of the invention may have a half-life of at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).

In another one aspect of the invention, a polypeptide of the invention comprises one or more (such as two or preferably one) NANOBODIES® ($V_{HH}$ sequences) of the invention linked (optionally via one or more suitable linker sequences) to one or more (such as two and preferably one) amino acid sequences that allow the resulting polypeptide of the invention to cross the blood brain barrier. In particular, said one or more amino acid sequences that allow the resulting polypeptides of the invention to cross the blood brain barrier may be one or more (such as two and preferably one) NANOBODIES® ($V_{HH}$ sequences), such as the NANOBODIES® ($V_{HH}$ sequences) described in WO 02/057445, of which FC44 (SEQ ID NO: 189 of WO 06/040153) and FC5 (SEQ ID NO: 190 of WO 06/040154) are preferred examples.

In particular, polypeptides comprising one or more NANOBODIES® ($V_{HH}$ sequences) of the invention are preferably such that they:

- bind to an envelope protein of a virus with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);

and/or such that they:

- bind to an envelope protein of a virus with a $k_{on}$-rate of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$;

and/or such that they:

- bind to an envelope protein of a virus with a $k_{off}$ rate between 1 $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Preferably, a polypeptide that contains only one amino acid sequence or NANOBODY® ($V_{HH}$ sequence) of the invention is preferably such that it will bind to an envelope protein of a virus with an affinity less than 500 nM, preferably less than 200 nM, more preferably less than 10 nM, such as less than 500 pM. In this respect, it will be clear to the skilled person that a polypeptide that contains two or more NANOBODIES® ($V_{HH}$ sequences) of the invention may bind to an envelope protein of a virus with an increased avidity, compared to a polypeptide that contains only one amino acid sequence or NANOBODY® ($V_{HH}$ sequence) of the invention.

Some preferred $IC_{50}$ values for binding of the amino acid sequences, NANOBODIES® ($V_{HH}$ sequences) or polypeptides of the invention to an envelope protein of a virus will become clear from the further description and examples herein.

Other polypeptides according to this preferred aspect of the invention may for example be chosen from the group consisting of amino acid sequences that have more than 80%, preferably more than 90%, more preferably more than 95%, such as 99% or more "sequence identity" (as defined herein) with one or more of the amino acid sequences of SEQ ID NO's: 2382 to 2415, 2423 to 2430, 2641 to 2659, 2663 to 2681, 2978 to 2998, 3016 to 3056 and 3584 to 3591 (see Table A-2, Table A-4, Table A-5, Table A-6, Table A-9 and Table A-10), in which the NANOBODIES® ($V_{HH}$ sequences) comprised within said amino acid sequences are preferably as further defined herein.

Another aspect of this invention relates to a nucleic acid that encodes an amino acid sequence of the invention (such as a NANOBODY® ($V_{HH}$ sequence) of the invention) or a polypeptide of the invention comprising the same. Again, as generally described herein for the nucleic acids of the invention, such a nucleic acid may be in the form of a genetic construct, as defined herein.

In another aspect, the invention relates to host or host cell that expresses or that is capable of expressing an amino acid sequence (such as a NANOBODY® ($V_{HH}$ sequence)) of the invention and/or a polypeptide of the invention comprising the same; and/or that contains a nucleic acid of the invention. Some preferred but non-limiting examples of such hosts or host cells will become clear from the further description herein.

Another aspect of the invention relates to a product or composition containing or comprising at least one amino acid sequence or NANOBODY® ($V_{HH}$ sequence) of the invention, at least one polypeptide of the invention and/or at least one nucleic acid of the invention, and optionally one or more further components of such compositions known per se, i.e. depending on the intended use of the composition. Such a product or composition may for example be a pharmaceutical composition (as described herein), a veterinary composition or a product or composition for diagnostic use (as also described herein). Some preferred but non-limiting examples of such products or compositions will become clear from the further description herein.

The invention further relates to methods for preparing or generating the amino acid sequences, NANOBODIES® ($V_{HH}$ sequences), compounds, constructs, polypeptides, nucleic acids, host cells, products and compositions described herein. Some preferred but non-limiting examples of such methods will become clear from the further description herein.

The invention further relates to applications and uses of the amino acid sequences, compounds, constructs, polypeptides, nucleic acids, host cells, products and compositions described herein, as well as to methods for the prevention and/or treatment for diseases and disorders associated with viral entry and/or viral replication and/or mediated by an envelope protein of a virus and/or its viral receptor. Some preferred but non-limiting applications and uses will become clear from the further description herein.

Other aspects, embodiments, advantages and applications of the invention will also become clear from the further description hereinbelow.

Generally, it should be noted that the term NANOBODY® ($V_{HH}$ sequence) as used herein in its broadest sense is not limited to a specific biological source or to a specific method of preparation. For example, as will be discussed in more detail below, the NANOBODIES® ($V_{HH}$ sequences) of the invention can generally be obtained by any of the techniques (1) to (8) mentioned on pages 61 and 62 of WO 08/020079, or any other suitable technique known per se. One preferred class of NANOBODIES® ($V_{HH}$ sequences) correspond to the $V_{HH}$ domains of naturally occurring heavy chain antibodies directed against an envelope protein of a virus. As further described herein, such $V_{HH}$ sequences can generally be generated or obtained by suitably immunizing a species of Camelid with an envelope protein of a virus (i.e. so as to raise an immune response and/or heavy chain antibodies directed against an envelope protein of a virus), by obtaining a suitable biological sample from said Camelid (such as a blood sample, serum sample or sample of B-cells), and by generating $V_{HH}$ sequences directed against an envelope protein of a virus, starting from said sample, using any suitable technique known per se. Such techniques will be clear to the skilled person and/or are further described herein.

Alternatively, such naturally occurring $V_{HH}$ domains against an envelope protein of a virus, can be obtained from naïve libraries of Camelid $V_{HH}$ sequences, for example by screening such a library using an envelope protein of a virus, or at least one part, fragment, antigenic determinant or epitope thereof using one or more screening techniques known per se. Such libraries and techniques are for example described in WO 99/37681, WO 01/90190, WO 03/025020 and WO 03/035694. Alternatively, improved synthetic or semi-synthetic libraries derived from naïve $V_{HH}$ libraries may be used, such as $V_{HH}$ libraries obtained from naïve $V_{HH}$ libraries by techniques such as random mutagenesis and/or CDR shuffling, as for example described in WO 00/43507.

Thus, in another aspect, the invention relates to a method for generating NANOBODIES® ($V_{HH}$ sequences), that are directed against an envelope protein of a virus. In one aspect, said method at least comprises the steps of:

a) providing a set, collection or library of NANOBODY® ($V_{HH}$ sequence) sequences; and
b) screening said set, collection or library of NANOBODY® ($V_{HH}$ sequence) sequences for NANOBODY® ($V_{HH}$ sequence) sequences that can bind to and/or have affinity for an envelope protein of a virus;

and c) isolating the amino acid sequence(s) that can bind to and/or have affinity for an envelope protein of a virus.

In such a method, the set, collection or library of NANOBODY® ($V_{HH}$ sequence) sequences may be a naïve set, collection or library of NANOBODY® ($V_{HH}$ sequence) sequences; a synthetic or semi-synthetic set, collection or library of NANOBODY® ($V_{HH}$ sequence) sequences; and/or a set, collection or library of NANOBODY® ($V_{HH}$ sequence) sequences that have been subjected to affinity maturation.

In a preferred aspect of this method, the set, collection or library of NANOBODY® ($V_{HH}$ sequence) sequences may be an immune set, collection or library of NANOBODY® ($V_{HH}$ sequence) sequences, and in particular an immune set, collection or library of $V_{HH}$ sequences, that have been derived from a species of Camelid that has been suitably immunized with an envelope protein of a virus or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

In the above methods, the set, collection or library of NANOBODY® ($V_{HH}$ sequence) or $V_{HH}$ sequences may be displayed on a phage, phagemid, ribosome or suitable micro-organism (such as yeast), such as to facilitate screening. Suitable methods, techniques and host organisms for displaying and screening (a set, collection or library of) NANOBODY® ($V_{HH}$ sequence) sequences will be clear to the person skilled in the art, for example on the basis of the further disclosure herein. Reference is also made to WO 03/054016 and to the review by Hoogenboom in Nature Biotechnology, 23, 9, 1105-1116 (2005).

In another aspect, the method for generating NANOBODY® ($V_{HH}$ sequence) sequences comprises at least the steps of:

a) providing a collection or sample of cells derived from a species of Camelid that express immunoglobulin sequences;
b) screening said collection or sample of cells for (i) cells that express an immunoglobulin sequence that can bind to and/or have affinity for an envelope protein of a virus; and (ii) cells that express heavy chain antibodies, in which substeps (i) and (ii) can be performed essentially as a single screening step or in any suitable order as two separate screening steps, so as to provide at least one cell that expresses a heavy chain antibody that can bind to and/or has affinity for an envelope protein of a virus;

and c) either (i) isolating from said cell the $V_{HH}$ sequence present in said heavy chain antibody; or (ii) isolating from said cell a nucleic acid sequence that encodes the $V_{HH}$ sequence present in said heavy chain antibody, followed by expressing said $V_{HH}$ domain.

In the method according to this aspect, the collection or sample of cells may for example be a collection or sample of B-cells. Also, in this method, the sample of cells may be derived from a Camelid that has been suitably immunized with an envelope protein of a virus or a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

The above method may be performed in any suitable manner, as will be clear to the skilled person. Reference is for example made to EP 0 542 810, WO 05/19824, WO 04/051268 and WO 04/106377. The screening of step b) is preferably performed using a flow cytometry technique such as FACS. For this, reference is for example made to Lieby et al., Blood, Vol. 97, No. 12, 3820. Particular reference is made to the so-called "NANOCLONE®" technique described in International application WO 06/079372 by Ablynx N.V.

In another aspect, the method for generating an amino acid sequence directed against an envelope protein of a virus may comprise at least the steps of:

a) providing a set, collection or library of nucleic acid sequences encoding heavy chain antibodies or NANOBODY® ($V_{HH}$ sequence) sequences;
b) screening said set, collection or library of nucleic acid sequences for nucleic acid sequences that encode a heavy chain antibody or a NANOBODY® ($V_{HH}$ sequence) sequence that can bind to and/or has affinity for an envelope protein of a virus;

and c) isolating said nucleic acid sequence, followed by expressing the $V_{HH}$ sequence present in said heavy chain antibody or by expressing said NANOBODY® ($V_{HH}$ sequence) sequence, respectively.

In such a method, the set, collection or library of nucleic acid sequences encoding heavy chain antibodies or NANOBODY® ($V_{HH}$ sequence) sequences may for example be a set, collection or library of nucleic acid sequences encoding a naïve set, collection or library of heavy chain antibodies or $V_{HH}$ sequences; a set, collection or library of nucleic acid sequences encoding a synthetic or semi-synthetic set, collection or library of NANOBODY® ($V_{HH}$ sequence) sequences; and/or a set, collection or library of nucleic acid sequences encoding a set, collection or library of NANOBODY® ($V_{HH}$ sequence) sequences that have been subjected to affinity maturation.

In a preferred aspect of this method, the set, collection or library of amino acid sequences may be an immune set, collection or library of nucleic acid sequences encoding heavy chain antibodies or $V_{HH}$ sequences derived from a Camelid that has been suitably immunized with an envelope protein of a virus or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

In the above methods, the set, collection or library of nucleotide sequences may be displayed on a phage, phagemid, ribosome or suitable micro-organism (such as yeast), such as to facilitate screening. Suitable methods, techniques and host organisms for displaying and screening (a set, collection or library of) nucleotide sequences encoding amino acid sequences will be clear to the person skilled in the art, for example on the basis of the further disclosure herein. Reference is also made to WO 03/054016 and to the review by Hoogenboom in Nature Biotechnology, 23, 9, 1105-1116 (2005).

As will be clear to the skilled person, the screening step of the methods described herein can also be performed as a selection step. Accordingly the term "screening" as used in the present description can comprise selection, screening or any suitable combination of selection and/or screening techniques. Also, when a set, collection or library of sequences is used, it may contain any suitable number of sequences, such as 1, 2, 3 or about 5, 10, 50, 100, 500, 1000, 5000, $10^4$, $10^5$, $10^6$, $10^7$, $10^8$ or more sequences.

Also, one or more or all of the sequences in the above set, collection or library of amino acid sequences may be obtained or defined by rational, or semi-empirical approaches such as computer modelling techniques or biostatics or datamining techniques.

Furthermore, such a set, collection or library can comprise one, two or more sequences that are variants from one another (e.g. with designed point mutations or with randomized positions), compromise multiple sequences derived from a diverse set of naturally diversified sequences (e.g. an immune library)), or any other source of diverse sequences (as described for example in Hoogenboom et al, Nat Biotechnol 23:1105, 2005 and Binz et al, Nat Biotechnol 2005, 23:1247). Such set, collection or library of sequences can be displayed on the surface of a phage particle, a ribosome, a bacterium, a yeast cell, a mammalian cell, and linked to the nucleotide sequence encoding the amino acid sequence within these carriers. This makes such set, collection or library amenable to selection procedures to isolate the desired amino acid sequences of the invention. More generally, when a sequence is displayed on a suitable host or host cell, it is also possible (and customary) to first isolate from said host or host cell a nucleotide sequence that encodes the desired sequence, and then to obtain the desired sequence by suitably expressing said nucleotide sequence in a suitable host organism. Again, this can be performed in any suitable manner known per se, as will be clear to the skilled person.

Yet another technique for obtaining $V_{HH}$ sequences or NANOBODY® ($V_{HH}$ sequence) sequences directed against an envelope protein of a virus involves suitably immunizing a transgenic mammal that is capable of expressing heavy chain antibodies (i.e. so as to raise an immune response and/or heavy chain antibodies directed against an envelope protein of a virus), obtaining a suitable biological sample from said transgenic mammal that contains (nucleic acid sequences encoding) said $V_{HH}$ sequences or NANOBODY® ($V_{HH}$ sequence) sequences (such as a blood sample, serum sample or sample of B-cells), and then generating $V_{HH}$ sequences directed against an envelope protein of a virus, starting from said sample, using any suitable technique known per se (such as any of the methods described herein or a hybridoma technique). For example, for this purpose, the heavy chain antibody-expressing mice and the further methods and techniques described in WO 02/085945, WO 04/049794 and WO 06/008548 and Janssens et al., Proc. Natl. Acad. Sci. USA. 2006 Oct. 10; 103(41):15130-5 can be used. For example, such heavy chain antibody expressing mice can express heavy chain antibodies with any suitable (single) variable domain, such as (single) variable domains from natural sources (e.g. human (single) variable domains, Camelid (single) variable domains or shark (single) variable domains), as well as for example synthetic or semi-synthetic (single) variable domains.

The invention also relates to the $V_{HH}$ sequences or NANOBODY® ($V_{HH}$ sequence) sequences that are obtainable and/or obtained by the above methods, or alternatively by a method that comprises the one of the above methods and in addition at least the steps of determining the nucleotide sequence or amino acid sequence of said $V_{HH}$ sequence or NANOBODY® ($V_{HH}$ sequence) sequence; and of expressing or synthesizing said $V_{HH}$ sequence or NANOBODY® ($V_{HH}$ sequence) sequence in a manner known per se, such as by expression in a suitable host cell or host organism or by chemical synthesis.

As mentioned herein, a particularly preferred class of NANOBO NANOBODIES® ($V_{HH}$ sequences) DIES® ($V_{HH}$ sequences) of the invention comprises NANOBODIES® ($V_{HH}$ sequences) with an amino acid sequence that corresponds to the amino acid sequence of a naturally occurring $V_{HH}$ domain, but that has been "humanized", i.e. by replacing one or more amino acid residues in the amino acid sequence of said naturally occurring $V_{HH}$ sequence (and in particular in the framework sequences) by one or more of the amino acid residues that occur at the corresponding position(s) in a $V_H$ domain from a conventional 4-chain antibody from a human being (e.g. indicated above), as further described on, and using the techniques mentioned on, page 63 of WO 08/020079. Another particularly preferred class of NANOBODIES® ($V_{HH}$ sequences) of the invention comprises NANOBODIES® ($V_{HH}$ sequences) with an amino acid sequence that corresponds to the amino acid sequence of a naturally occurring $V_H$ domain, but that has been "camelized", i.e. by replacing one or more amino acid residues in the amino acid sequence of a naturally occurring $V_H$ domain from a conventional 4-chain antibody by one or more of the amino acid residues that occur at the corresponding position(s) in a $V_{HH}$ domain of a heavy chain antibody, as further described on, and using the techniques mentioned on, page 63 of WO 08/020079.

Other suitable methods and techniques for obtaining the NANOBODIES® NANOBODIES® ($V_{HH}$ sequences) ($V_{HH}$ sequences) of the invention and/or nucleic acids encoding the same, starting from naturally occurring $V_H$ sequences or preferably $V_{HH}$ sequences, will be clear from the skilled person, and may for example include the techniques that are mentioned on page 64 of WO 08/00279. As mentioned herein, NANOBODIES® ($V_{HH}$ sequences) may in particular be characterized by the presence of one or more "Hallmark residues" (as described herein) in one or more of the framework sequences.

Thus, according to one preferred, but non-limiting aspect of the invention, a NANOBODY® ($V_{HH}$ sequence) in its broadest sense can be generally defined as a polypeptide comprising:

a) an amino acid sequence that is comprised of four framework regions/sequences interrupted by three complementarity determining regions/sequences, in which the amino acid residue at position 108 according to the Kabat numbering is Q;

and/or:

b) an amino acid sequence that is comprised of four framework regions/sequences interrupted by three complementarity determining regions/sequences, in which the amino acid residue at position 45 according to the Kabat numbering is a charged amino acid (as defined herein) or a cysteine residue, and position 44 is preferably an E;

and/or:

c) an amino acid sequence that is comprised of four framework regions/sequences interrupted by three complementarity determining regions/sequences, in which the amino acid residue at position 103 according to the Kabat numbering is chosen from the group consisting of P, R and S, and is in particular chosen from the group consisting of R and S.

Thus, in a first preferred, but non-limiting aspect, a NANOBODY® ($V_{HH}$ sequence) of the invention may have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which a) the amino acid residue at position 108 according to the Kabat numbering is Q;

and/or in which:

b) the amino acid residue at position 45 according to the Kabat numbering is a charged amino acid or a cysteine and the amino acid residue at position 44 according to the Kabat numbering is preferably E;

and/or in which:

c) the amino acid residue at position 103 according to the Kabat numbering is chosen from the group consisting of P, R and S, and is in particular chosen from the group consisting of R and S;

and in which:

d) CDR1, CDR2 and CDR3 are as defined herein, and are preferably as defined according to one of the preferred aspects herein, and are more preferably as defined according to one of the more preferred aspects herein.

In particular, a NANOBODY® ($V_{HH}$ sequence) in its broadest sense can be generally defined as a polypeptide comprising:

a) an amino acid sequence that is comprised of four framework regions/sequences interrupted by three complementarity determining regions/sequences, in which the amino acid residue at position 108 according to the Kabat numbering is Q;

and/or:

b) an amino acid sequence that is comprised of four framework regions/sequences interrupted by three complementarity determining regions/sequences, in which the amino acid residue at position 44 according to the Kabat numbering is E and in which the amino acid residue at position 45 according to the Kabat numbering is an R; and/or:

c) an amino acid sequence that is comprised of four framework regions/sequences interrupted by three complementarity determining regions/sequences, in which the amino acid residue at position 103 according to the Kabat numbering is chosen from the group consisting of P, R and S, and is in particular chosen from the group consisting of R and S.

Thus, according to a preferred, but non-limiting aspect, a NANOBODY® ($V_{HH}$ sequence) of the invention may have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which a) the amino acid residue at position 108 according to the Kabat numbering is Q; and/or in which:

b) the amino acid residue at position 44 according to the Kabat numbering is E and in which the amino acid residue at position 45 according to the Kabat numbering is an R; and/or in which:

c) the amino acid residue at position 103 according to the Kabat numbering is chosen from the group consisting of P, R and S, and is in particular chosen from the group consisting of R and S;

and in which:

d) CDR1, CDR2 and CDR3 are as defined herein, and are preferably as defined according to one of the preferred aspects herein, and are more preferably as defined according to one of the more preferred aspects herein.

In particular, a NANOBODY® ($V_{HH}$ sequence) against an envelope protein of a virus according to the invention may have the structure:

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which a) the amino acid residue at position 108 according to the Kabat numbering is Q; and/or in which:

b) the amino acid residue at position 44 according to the Kabat numbering is E and in which the amino acid residue at position 45 according to the Kabat numbering is an R;

and/or in which:

c) the amino acid residue at position 103 according to the Kabat numbering is chosen from the group consisting of P, R and S, and is in particular chosen from the group consisting of R and S;

and in which:

d) CDR1, CDR2 and CDR3 are as defined herein, and are preferably as defined according to one of the preferred aspects herein, and are more preferably as defined according to one of the more preferred aspects herein.

In particular, according to one preferred, but non-limiting aspect of the invention, a NANOBODY® ($V_{HH}$ sequence) can generally be defined as a polypeptide comprising an amino acid sequence that is comprised of four framework regions/sequences interrupted by three complementarity determining regions/sequences, in which;

a-1) the amino acid residue at position 44 according to the Kabat numbering is chosen from the group consisting of A, G, E, D, G, Q, R, S, L; and is preferably chosen from the group consisting of G, E or Q; and a-2) the amino acid residue at position 45 according to the Kabat numbering is chosen from the group consisting of L, R or C; and is preferably chosen from the group consisting of L or R; and a-3) the amino acid residue at position 103 according to the Kabat numbering is chosen from the group consisting of W, R or S; and is preferably W or R, and is most preferably W;

a-4) the amino acid residue at position 108 according to the Kabat numbering is Q;

or in which:

b-1) the amino acid residue at position 44 according to the Kabat numbering is chosen from the group consisting of E and Q; and b-2) the amino acid residue at position 45 according to the Kabat numbering is R; and b-3) the amino acid residue at position 103 according to the Kabat numbering is chosen from the group consisting of W, R and S; and is preferably W;

b-4) the amino acid residue at position 108 according to the Kabat numbering is chosen from the group consisting of Q and L; and is preferably Q;

or in which:

c-1) the amino acid residue at position 44 according to the Kabat numbering is chosen from the group consisting of A, G, E, D, Q, R, S and L; and is preferably chosen from the group consisting of G, E and Q; and c-2) the amino acid residue at position 45 according to the Kabat numbering is chosen from the group consisting of L, R and C; and is preferably chosen from the group consisting of L and R; and c-3) the amino acid residue at position 103 according to the Kabat numbering is chosen from the group consisting of P, R and S; and is in particular chosen from the group consisting of R and S; and c-4) the amino acid residue at position 108 according to the Kabat numbering is chosen from the group consisting of Q and L; is preferably Q;

and in which d) CDR1, CDR2 and CDR3 are as defined herein, and are preferably as defined according to one of the preferred aspects herein, and are more preferably as defined according to one of the more preferred aspects herein.

Thus, in another preferred, but non-limiting aspect, a NANOBODY® ($V_{HH}$ sequence) of the invention may have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

a-1) the amino acid residue at position 44 according to the Kabat numbering is chosen from the group consisting of A, G, E, D, G, Q, R, S, L; and is preferably chosen from the group consisting of G, E or Q;

and in which:

a-2) the amino acid residue at position 45 according to the Kabat numbering is chosen from the group consisting of L, R or C; and is preferably chosen from the group consisting of L or R;

and in which:

a-3) the amino acid residue at position 103 according to the Kabat numbering is chosen from the group consisting of W, R or S; and is preferably W or R, and is most preferably W;

and in which a-4) the amino acid residue at position 108 according to the Kabat numbering is Q;

and in which:

d) CDR1, CDR2 and CDR3 are as defined herein, and are preferably as defined according to one of the preferred aspects herein, and are more preferably as defined according to one of the more preferred aspects herein.

In another preferred, but non-limiting aspect, a NANOBODY® ($V_{HH}$ sequence) of the invention may have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

b-1) the amino acid residue at position 44 according to the Kabat numbering is chosen from the group consisting of E and Q;

and in which:

b-2) the amino acid residue at position 45 according to the Kabat numbering is R;

and in which:

b-3) the amino acid residue at position 103 according to the Kabat numbering is chosen from the group consisting of W, R and S; and is preferably W;

and in which:

b-4) the amino acid residue at position 108 according to the Kabat numbering is chosen from the group consisting of Q and L; and is preferably Q;

and in which:

d) CDR1, CDR2 and CDR3 are as defined herein, and are preferably as defined according to one of the preferred aspects herein, and are more preferably as defined according to one of the more preferred aspects herein.

In another preferred, but non-limiting aspect, a NANOBODY® ($V_{HH}$ sequence) of the invention may have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

c-1) the amino acid residue at position 44 according to the Kabat numbering is chosen from the group consisting of A, G, E, D, Q, R, S and L; and is preferably chosen from the group consisting of G, E and Q;

and in which:

c-2) the amino acid residue at position 45 according to the Kabat numbering is chosen from the group consisting of L, R and C; and is preferably chosen from the group consisting of L and R;

and in which:

c-3) the amino acid residue at position 103 according to the Kabat numbering is chosen from the group consisting of P, R and S; and is in particular chosen from the group consisting of R and S;

and in which:

c-4) the amino acid residue at position 108 according to the Kabat numbering is chosen from the group consisting of Q and L; is preferably Q;

and in which:

d) CDR1, CDR2 and CDR3 are as defined herein, and are preferably as defined according to one of the preferred aspects herein, and are more preferably as defined according to one of the more preferred aspects herein.

Two particularly preferred, but non-limiting groups of the NANOBODIES® ($V_{HH}$ sequences) of the invention are those according to a) above; according to (a-1) to (a-4) above; according to b) above; according to (b-1) to (b-4) above; according to (c) above; and/or according to (c-1) to (c-4) above, in which either:

i) the amino acid residues at positions 44-47 according to the Kabat numbering form the sequence GLEW (or a GLEW-like sequence as described herein) and the amino acid residue at position 108 is Q;

or in which:

ii) the amino acid residues at positions 43-46 according to the Kabat numbering form the sequence KERE or KQRE (or a KERE-like sequence as described) and the amino acid residue at position 108 is Q or L, and is preferably Q.

Thus, in another preferred, but non-limiting aspect, a NANOBODY® ($V_{HH}$ sequence) of the invention may have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

i) the amino acid residues at positions 44-47 according to the Kabat numbering form the sequence GLEW (or a GLEW-like sequence as defined herein) and the amino acid residue at position 108 is Q;

and in which:

ii) CDR1, CDR2 and CDR3 are as defined herein, and are preferably as defined according to one of the preferred aspects herein, and are more preferably as defined according to one of the more preferred aspects herein.

In another preferred, but non-limiting aspect, a NANOBODY® ($V_{HH}$ sequence) of the invention may have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

i) the amino acid residues at positions 43-46 according to the Kabat numbering form the sequence KERE or KQRE (or a KERE-like sequence) and the amino acid residue at position 108 is Q or L, and is preferably Q;

and in which:

ii) CDR1, CDR2 and CDR3 are as defined herein, and are preferably as defined according to one of the preferred aspects herein, and are more preferably as defined according to one of the more preferred aspects herein.

In the NANOBODIES® ($V_{HH}$ sequences) of the invention in which the amino acid residues at positions 43-46 according to the Kabat numbering form the sequence KERE or KQRE, the amino acid residue at position 37 is most preferably F. In the NANOBODIES® ($V_{HH}$ sequences) of the invention in which the amino acid residues at positions 44-47 according to the Kabat numbering form the sequence GLEW, the amino acid residue at position 37 is chosen from the group consisting of Y, H, I, L, V or F, and is most preferably V.

Thus, without being limited hereto in any way, on the basis of the amino acid residues present on the positions mentioned above, the NANOBODIES® ($V_{HH}$ sequences) of the invention can generally be classified on the basis of the following three groups:

i) The "GLEW-group": NANOBODIES® ($V_{HH}$ sequences) with the amino acid sequence GLEW at positions 44-47 according to the Kabat numbering and Q at position 108 according to the Kabat numbering. As further described herein, NANOBODIES® ($V_{HH}$ sequences) within this group usually have a V at position 37, and can have a W, P, R or S at position 103, and preferably have a W at position 103. The GLEW group also comprises some GLEW-like sequences such as those mentioned in Table B-2 below. More generally, and without limitation, NANOBODIES® ($V_{HH}$ sequences) belonging to the GLEW-group can be defined as NANOBODIES® ($V_{HH}$ sequences) with a G at position 44 and/or with a W at position 47, in which position 46 is usually E and in which preferably position 45 is not a charged amino acid residue and not cysteine;

ii) The "KERE-group": NANOBODIES® ($V_{HH}$ sequences) with the amino acid sequence KERE or KQRE (or another KERE-like sequence) at positions 43-46 according to the Kabat numbering and Q or L at position 108 according to the Kabat numbering. As further described herein, NANOBODIES® ($V_{HH}$ sequences) within this group usually have a F at position 37, an L or F at position 47; and can have a W, P, R or S at position 103, and preferably have a W at position 103. More generally, and without limitation, NANOBODIES® ($V_{HH}$ sequences) belonging to the KERE-group can be defined as NANOBODIES® ($V_{HH}$ sequences) with a K, Q or R at position 44 (usually K) in which position 45 is a charged amino acid residue or cysteine, and position 47 is as further defined herein;

iii) The "103 P, R, S-group": NANOBODIES® ($V_{HH}$ sequences) with a P, R or S at position 103. These NANOBODIES® ($V_{HH}$ sequences) can have either the amino acid sequence GLEW at positions 44-47 according to the Kabat numbering or the amino acid sequence KERE or KQRE at positions 43-46 according to the Kabat numbering, the latter most preferably in combination with an F at position 37 and an L or an F at position 47 (as defined for the KERE-group); and can have Q or L at position 108 according to the Kabat numbering, and preferably have Q.

Also, where appropriate, NANOBODIES® ($V_{HH}$ sequences) may belong to (i.e. have characteristics of) two or more of these classes. For example, one specifically preferred group of NANOBODIES® ($V_{HH}$ sequences) has GLEW or a GLEW-like sequence at positions 44-47; P, R or S (and in particular R) at position 103; and Q at position 108 (which may be humanized to L).

More generally, it should be noted that the definitions referred to above describe and apply to NANOBODIES® ($V_{HH}$ sequences) in the form of a native (i.e. non-humanized) $V_{HH}$ sequence, and that humanized variants of these NANOBODIES® ($V_{HH}$ sequences) may contain other amino acid residues than those indicated above (i.e. one or more humanizing substitutions as defined herein). For example, and without limitation, in some humanized NANOBODIES® ($V_{HH}$ sequences) of the GLEW-group or the 103 P, R, S-group, Q at position 108 may be humanized to 108 L. As already mentioned herein, other humanizing substitutions (and suitable combinations thereof) will become clear to the skilled person based on the disclosure herein. In addition, or alternatively, other potentially useful humanizing substitutions can be ascertained by comparing the sequence of the framework regions of a naturally occurring $V_{HH}$ sequence with the corresponding framework sequence of one or more closely related human $V_H$ sequences, after which one or more of the potentially useful humanizing substitutions (or combinations thereof) thus determined can be introduced into said $V_{HH}$ sequence (in any manner known per se, as further described herein) and the resulting humanized $V_{HH}$ sequences can be tested for affinity for the target, for stability, for ease and level of expression, and/or for other desired properties. In this way, by means of a limited degree of trial and error, other suitable humanizing substitutions (or suitable combinations thereof) can be determined by the skilled person based on the disclosure herein. Also, based on the foregoing, (the framework regions of) a NANOBODY® ($V_{HH}$ sequence) may be partially humanized or fully humanized.

Thus, in another preferred, but non-limiting aspect, a NANOBODY® ($V_{HH}$ sequence) of the invention may be a NANOBODY® ($V_{HH}$ sequence) belonging to the GLEW-group (as defined herein), and in which CDR1, CDR2 and CDR3 are as defined herein, and are preferably as defined according to one of the preferred aspects herein, and are more preferably as defined according to one of the more preferred aspects herein.

In another preferred, but non-limiting aspect, a NANOBODY® ($V_{HH}$ sequence) of the invention may be a NANOBODY® ($V_{HH}$ sequence) belonging to the KERE-group (as defined herein), and CDR1, CDR2 and CDR3 are as defined herein, and are preferably as defined according to one of the preferred aspects herein, and are more preferably as defined according to one of the more preferred aspects herein.

Thus, in another preferred, but non-limiting aspect, a NANOBODY® ($V_{HH}$ sequence) of the invention may be a NANOBODY® ($V_{HH}$ sequence) belonging to the 103 P, R, S-group (as defined herein), and in which CDR1, CDR2 and CDR3 are as defined herein, and are preferably as defined according to one of the preferred aspects herein, and are more preferably as defined according to one of the more preferred aspects herein.

Also, more generally and in addition to the 108Q, 43E/44R and 103 P,R,S residues mentioned above, the NANOBODIES® ($V_{HH}$ sequences) of the invention can contain, at one or more positions that in a conventional $V_H$ domain would form (part of) the $V_H/V_L$ interface, one or more amino acid residues that are more highly charged than the amino acid residues that naturally occur at the same position(s) in the corresponding naturally occurring $V_H$ sequence, and in particular one or more charged amino acid residues (as mentioned in Table A-2 on page 48 of the International application WO 08/020079). Such substitutions include, but are not limited to, the GLEW-like sequences mentioned in Table B-2 below; as well as the substitutions that are described in the International Application WO 00/29004 for so-called “microbodies”, e.g. so as to obtain a NANOBODY® ($V_{HH}$ sequence) with Q at position 108 in combination with KLEW at positions 44-47. Other possible substitutions at these positions will be clear to the skilled person based upon the disclosure herein.

In one aspect of the NANOBODIES® ($V_{HH}$ sequences) of the invention, the amino acid residue at position 83 is chosen from the group consisting of L, M, S, V and W; and is preferably L.

Also, in one aspect of the NANOBODIES® ($V_{HH}$ sequences) of the invention, the amino acid residue at position 83 is chosen from the group consisting of R, K, N, E, G, I, T and Q; and is most preferably either K or E (for NANOBODIES® ($V_{HH}$ sequences) corresponding to naturally occurring $V_{HH}$ domains) or R (for “humanized” NANOBODIES® ($V_{HH}$ sequences), as described herein). The amino acid residue at position 84 is chosen from the group consisting of P, A, R, S, D T, and V in one aspect, and is most preferably P (for NANOBODIES® ($V_{HH}$ sequences) corresponding to naturally occurring $V_{HH}$ domains) or R (for “humanized” NANOBODIES® ($V_{HH}$ sequences), as described herein).

Furthermore, in one aspect of the NANOBODIES® ($V_{HH}$ sequences) of the invention, the amino acid residue at position 104 is chosen from the group consisting of G and D; and is most preferably G.

Collectively, the amino acid residues at positions 11, 37, 44, 45, 47, 83, 84, 103, 104 and 108, which in the NANOBODIES® ($V_{HH}$ sequences) are as mentioned above, will also be referred to herein as the “Hallmark Residues”. The Hallmark Residues and the amino acid residues at the corresponding positions of the most closely related human $V_H$ domain, $V_H3$, are summarized in Table B-2.

Some especially preferred but non-limiting combinations of these Hallmark Residues as occur in naturally occurring $V_{HH}$ domains are mentioned in Table B-3. For comparison, the corresponding amino acid residues of the human $V_H3$ called DP-47 have been indicated in italics.

TABLE B-2

Hallmark Residues in Nanobodies

| Position | Human $V_H3$ | Hallmark Residues |
|---|---|---|
| 11 | L, V; predominantly L | L, M, S, V, W; preferably L |
| 37 | V, I, F; usually V | F[1], Y, H, I, L or V, preferably F[1] or Y |
| 44[8] | G | G[2], E[3], A, D, Q, R, S, L; preferably G[2], E[3] or Q; most preferably G[2] or E[3]. |
| 45[8] | L | L[2], R[3], C, I, L, P, Q, V; preferably L[2] or R[3] |
| 47[8] | W, Y | W[2], L[1] or F[1], A, G, I, M, R, S, V or Y; preferably W[2], L[1], F[1] or R |
| 83 | R or K; usually R | R, K[5], N, E[5], G, I, M, Q or T; preferably K or R; most preferably K |
| 84 | A, T, D; predominantly A | P[5], A, L, R, S, T, D, V; preferably P |
| 103 | W | W[4], P[6], R[6], S; preferably W |
| 104 | G | G or D; preferably G |
| 108 | L, M or T; predominantly L | Q, L[7] or R; preferably Q or L[7] |

Notes:
[1]In particular, but not exclusively, in combination with KERE or KQRE at positions 43-46.
[2]Usually as GLEW at positions 44-47.
[3]Usually as KERE or KQRE at positions 43-46, e.g. as KEREL, KEREF, KQREL, KQREF or KEREG at positions 43-47. Alternatively, also sequences such as TERE (for example TEREL), KECE (for example KECEL or KECER), RERE (for example REREG), QERE (for example QEREG), KGRE (for example KGREG), KDRE (for example KDREV) are possible. Some other possible, but less preferred sequences include for example DECKL and NVCEL.
[4]With both GLEW at positions 44-47 and KERE or KQRE at positions 43-46.
[5]Often as KP or EP at positions 83-84 of naturally occurring $V_{HH}$ domains.
[6]In particular, but not exclusively, in combination with GLEW at positions 44-47.
[7]With the proviso that when positions 44-47 are GLEW, position 108 is always Q in (non-humanized) $V_{HH}$ sequences that also contain a W at position 103.
The GLEW group also contains GLEW-like sequences at positions 44-47, such as for example GVEW, EPEW, GLER, DQEW, DLEW, GIEW, ELEW, GPEW, EWLP, GPER, GLER and ELEW.

TABLE B-3

Some preferred but non-limiting combinations of Hallmark Residues in naturally occurring Nanobodies. For humanization of these combinations, reference is made to the specification.

| | 11 | 37 | 44 | 45 | 47 | 83 | 84 | 103 | 104 | 108 |
|---|---|---|---|---|---|---|---|---|---|---|
| *DP-47 (human)* | *M* | *V* | *G* | *L* | *W* | *R* | *A* | *W* | *G* | *L* |
| “KERE” group | L | F | E | R | L | K | P | W | G | Q |
| | L | F | E | R | F | E | P | W | G | Q |
| | L | F | E | R | F | K | P | W | G | Q |
| | L | Y | Q | R | L | K | P | W | G | Q |
| | L | F | L | R | V | K | P | Q | G | Q |
| | L | F | Q | R | L | K | P | W | G | Q |
| | L | F | E | R | F | K | P | W | G | Q |
| “GLEW” group | L | V | G | L | W | K | S | W | G | Q |
| | M | V | G | L | W | K | P | R | G | Q |

In the NANOBODIES® ($V_{HH}$ sequences), each amino acid residue at any other position than the Hallmark Residues can be any amino acid residue that naturally occurs at the corresponding position (according to the Kabat numbering) of a naturally occurring $V_{HH}$ domain.

Such amino acid residues will be clear to the skilled person. Tables B-4 to B-7 mention some non-limiting residues that can be present at each position (according to the Kabat numbering) of the FR1, FR2, FR3 and FR4 of naturally occurring $V_{HH}$ domains. For each position, the amino acid residue that most frequently occurs at each position of a naturally occurring $V_{HH}$ domain (and which is the most preferred amino acid residue for said position in a NANOBODY® ($V_{HH}$ sequence)) is indicated in bold; and other preferred amino acid residues for each position have been underlined (note: the number of amino acid residues that are found at positions 26-30 of naturally occurring $V_{HH}$ domains supports the hypothesis underlying the numbering by Chothia (supra) that the residues at these positions already form part of CDR1.)

In Tables B-4 to B-7, some of the non-limiting residues that can be present at each position of a human $V_H3$ domain have also been mentioned. Again, for each position, the amino acid residue that most frequently occurs at each position of a naturally occurring human $V_H3$ domain is indicated in bold; and other preferred amino acid residues have been underlined.

For reference only, Tables B-4 to B-7 also contain data on the $V_{HH}$ entropy ("$V_{HH}$ Ent.") and $V_{HH}$ variability ("$V_{HH}$ Var.") at each amino acid position for a representative sample of 1118 $V_{HH}$ sequences (data kindly provided by David Lutje Hulsing and Prof. Theo Verrips of Utrecht University). The values for the $V_{HH}$ entropy and the $V_{HH}$ variability provide a measure for the variability and degree of conservation of amino acid residues between the 1118 $V_{HH}$ sequences analyzed: low values (i.e. <1, such as <0.5) indicate that an amino acid residue is highly conserved between the $V_{HH}$ sequences (i.e. little variability). For example, the G at position 8 and the G at position 9 have values for the $V_{HH}$ entropy of 0.1 and 0 respectively, indicating that these residues are highly conserved and have little variability (and in case of position 9 is G in all 1118 sequences analysed), whereas for residues that form part of the CDR's generally values of 1.5 or more are found (data not shown). Note that (1) the amino acid residues listed in the second column of Tables B-4 to B-7 are based on a bigger sample than the 1118 $V_{HH}$ sequences that were analysed for determining the $V_{HH}$ entropy and $V_{HH}$ variability referred to in the last two columns; and (2) the data represented below support the hypothesis that the amino acid residues at positions 27-30 and maybe even also at positions 93 and 94 already form part of the CDR's (although the invention is not limited to any specific hypothesis or explanation, and as mentioned above, herein the numbering according to Kabat is used). For a general explanation of sequence entropy, sequence variability and the methodology for determining the same, see Oliveira et al., PROTEINS: Structure, Function and Genetics, 52: 544-552 (2003).

TABLE B-4

Non-limiting examples of amino acid residues in FR1
(for the footnotes, see the footnotes to Table B-2)

| | Amino acid residue(s): | | $V_{HH}$ | $V_{HH}$ |
|---|---|---|---|---|
| Pos. | Human $V_H3$ | Camelid $V_{HH}$'s | Ent. | Var. |
| 1 | **E**, Q | **Q**, A, E | — | — |
| 2 | **V** | **V** | 0.2 | 1 |
| 3 | **Q** | **Q**, K | 0.3 | 2 |
| 4 | **L** | **L** | 0.1 | 1 |
| 5 | **V**, L | **Q**, E, L, V | 0.8 | 3 |
| 6 | **E** | **E**, D, Q, A | 0.8 | 4 |
| 7 | **S**, T | **S**, F | 0.3 | 2 |
| 8 | **G**, R | **G** | 0.1 | 1 |
| 9 | **G** | **G** | 0 | 1 |
| 10 | **G**, V | **G**, D, R | 0.3 | 2 |
| 11 | Hallmark residue: L, M, S, V, W; preferably L | | 0.8 | 2 |
| 12 | **V**, I | **V**, A | 0.2 | 2 |
| 13 | **Q**, K, R | **Q**, E, K, P, R | 0.4 | 4 |
| 14 | **P** | **A**, Q, A, G, P, S, T, V | 1 | 5 |
| 15 | **G** | **G** | 0 | 1 |
| 16 | **G**, R | **G**, A, E, D | 0.4 | 3 |
| 17 | **S** | **S**, F | 0.5 | 2 |
| 18 | **L** | **L**, V | 0.1 | 1 |
| 19 | **R**, K | **R**, K, L, N, S, T | 0.6 | 4 |
| 20 | **L** | **L**, F, I, V | 0.5 | 4 |
| 21 | **S** | **S**, A, F, T | 0.2 | 3 |
| 22 | **C** | **C** | 0 | 1 |
| 23 | **A**, T | **A**, D, E, P, S, T, V | 1.3 | 5 |
| 24 | **A** | **A**, I, L, S, T, V | 1 | 6 |
| 25 | **S** | **S**, A, F, P, T | 0.5 | 5 |
| 26 | **G** | **G**, A, D, E, R, S, T, V | 0.7 | 7 |
| 27 | **F** | S, F, R, L, P, G, N, | 2.3 | 13 |
| 28 | **T** | N, T, E, D, S, I, R, A, G, R, F, Y | 1.7 | 11 |
| 29 | **F**, V | F, L, D, S, I, G, V, A | 1.9 | 11 |
| 30 | **S**, D, G | N, S, E, G, A, D, M, T | 1.8 | 11 |

TABLE B-5

Non-limiting examples of amino acid residues in FR2
(for the footnotes, see the footnotes to Table B-2)

| | Amino acid residue(s): | | $V_{HH}$ | $V_{HH}$ |
|---|---|---|---|---|
| Pos. | Human $V_H3$ | Camelid $V_{HH}$'s | Ent. | Var. |
| 36 | **W** | **W** | 0.1 | 1 |
| 37 | Hallmark residue: $F^{(1)}$, H, I, L, Y or V, preferably $F^{(1)}$ or Y | | 1.1 | 6 |
| 38 | **R** | **R** | 0.2 | 1 |
| 39 | **Q** | **Q**, H, P, R | 0.3 | 2 |
| 40 | **A** | **A**, F, G, L, P, T, V | 0.9 | 7 |
| 41 | **P**, S, T | **P**, A, L, S | 0.4 | 3 |
| 42 | **G** | **G**, E | 0.2 | 2 |
| 43 | **K** | **K**, D, E, N, Q, R, T, V | 0.7 | 6 |
| 44 | Hallmark residue: $G^{(2)}$, $E^{(3)}$, A, D, Q, R, S, L; preferably $G^{(2)}$, $E^{(3)}$ or Q; most preferably $G^{(2)}$ or $E^{(3)}$. | | 1.3 | 5 |
| 45 | Hallmark residue: $L^{(2)}$, $R^{(3)}$, C, I, L, P, Q, V; preferably $L^{(2)}$ or $R^{(3)}$ | | 0.6 | 4 |
| 46 | **E**, V | **E**, D, K, Q, V | 0.4 | 2 |
| 47 | Hallmark residue: $W^{(2)}$, $L^{(1)}$ or $F^{(1)}$, A, G, I, M, R, S, V or Y; preferably $W^{(2)}$, $L^{(1)}$, $F^{(1)}$ or R | | 1.9 | 9 |
| 48 | **V** | **V**, I, L | 0.4 | 3 |
| 49 | **S**, A, G | **A**, S, G, T, V | 0.8 | 3 |

TABLE B-6

Non-limiting examples of amino acid residues in FR3
(for the footnotes, see the footnotes to Table B-2)

| | Amino acid residue(s): | | $V_{HH}$ | $V_{HH}$ |
|---|---|---|---|---|
| Pos. | Human $V_H3$ | Camelid $V_{HH}$'s | Ent. | Var. |
| 66 | **R** | **R** | 0.1 | 1 |
| 67 | **F** | **F**, L, V | 0.1 | 1 |
| 68 | **T** | **T**, A, N, S | 0.5 | 4 |
| 69 | **I** | **I**, L, M, V | 0.4 | 4 |
| 70 | **S** | **S**, A, F, T | 0.3 | 4 |
| 71 | **R** | **R**, G, H, I, L, K, Q, S, T, W | 1.2 | 8 |
| 72 | **D**, E | **D**, E, G, N, V | 0.5 | 4 |
| 73 | **N**, D, G | **N**, A, D, F, I, K, L, R, S, T, V, Y | 1.2 | 9 |
| 74 | **A**, S | **A**, D, G, N, P, S, T, V | 1 | 7 |
| 75 | **K** | **K**, A, E, K, L, N, Q, R | 0.9 | 6 |
| 76 | **N**, S | **N**, D, K, R, S, T, Y | 0.9 | 6 |
| 77 | S, T, I | **T**, A, E, I, M, P, S | 0.8 | 5 |
| 78 | **L**, A | **V**, L, A, F, G, I, M | 1.2 | 5 |
| 79 | **Y**, H | **Y**, A, D, F, H, N, S, T | 1 | 7 |
| 80 | **L** | **L**, F, V | 0.1 | 1 |
| 81 | **Q** | **Q**, E, I, L, R, T | 0.6 | 5 |
| 82 | **M** | **M**, I, L, V | 0.2 | 2 |
| 82a | **N**, G | **N**, D, G, H, S, T | 0.8 | 4 |
| 82b | **S** | **S**, N, D, G, R, T | 1 | 6 |
| 82c | **L** | **L**, P, V | 0.1 | 2 |
| 83 | Hallmark residue: R, $K^{(5)}$, N, $E^{(5)}$, G, I, M, Q or T; preferably K or R; most preferably K | | 0.9 | 7 |
| 84 | Hallmark residue: $P^{(5)}$, A, D, L, R, S, T, V; preferably P | | 0.7 | 6 |

TABLE B-6-continued

| Non-limiting examples of amino acid residues in FR3 (for the footnotes, see the footnotes to Table B-2) | | | | |
|---|---|---|---|---|
| | Amino acid residue(s): | | $V_{HH}$ | $V_{HH}$ |
| Pos. | Human $V_H3$ | Camelid $V_{HH}$'s | Ent. | Var. |
| 85 | **E**, G | **E**, D, G, Q | 0.5 | 3 |
| 86 | **D** | **D** | 0 | 1 |
| 87 | **T**, M | **T**, A, S | 0.2 | 3 |
| 88 | **A** | **A**, G, S | 0.3 | 2 |
| 89 | **V**, L | **V**, A, D, I, L, M, N, R, T | 1.4 | 6 |
| 90 | **Y** | **Y**, F | 0 | 1 |
| 91 | **Y**, H | **Y**, D, F, H, L, S, T, V | 0.6 | 4 |
| 92 | **C** | **C** | 0 | 1 |
| 93 | **A**, K, T | **A**, N, G, H, K, N, R, S, T, V, Y | 1.4 | 10 |
| 94 | **K**, R, T | **A**, V, C, F, G, I, K, L, R, S or T | 1.6 | 9 |

TABLE B-7

| Non-limiting examples of amino acid residues in FR4 (for the footnotes, see the footnotes to Table B-2) | | | | |
|---|---|---|---|---|
| | Amino acid residue(s): | | $V_{HH}$ | $V_{HH}$ |
| Pos. | Human $V_H3$ | Camelid $V_{HH}$'s | Ent. | Var. |
| 103 | Hallmark residue: W(4), P(6), R(6), S; preferably W | | 0.4 | 2 |
| 104 | Hallmark residue: G or D; preferably G | | 0.1 | 1 |
| 105 | **Q**, R | **Q**, E, K, P, R | 0.6 | 4 |
| 106 | **G** | **G** | 0.1 | 1 |
| 107 | **T** | **T**, A, I | 0.3 | 2 |
| 108 | Hallmark residue: Q, L(7) or R: preferably Q or L(7) | | 0.4 | 3 |
| 109 | **V** | **V** | 0.1 | 1 |
| 110 | **T** | **T**, I, A | 0.2 | 1 |
| 111 | **V** | **V**, A, I | 0.3 | 2 |
| 112 | **S** | **S**, F | 0.3 | 1 |
| 113 | **S** | **S**, A, L, P, T | 0.4 | 3 |

Thus, in another preferred, but not limiting aspect, a NANOBODY® ($V_{HH}$ sequence) of the invention can be defined as an amino acid sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

i) one or more of the amino acid residues at positions 11, 37, 44, 45, 47, 83, 84, 103, 104 and 108 according to the Kabat numbering are chosen from the Hallmark residues mentioned in Table B-2;

and in which:

ii) CDR1, CDR2 and CDR3 are as defined herein, and are preferably as defined according to one of the preferred aspects herein, and are more preferably as defined according to one of the more preferred aspects herein.

The above NANOBODIES® ($V_{HH}$ sequences) may for example be $V_{HH}$ sequences or may be humanized NANOBODIES® ($V_{HH}$ sequences). When the above NANOBODY® ($V_{HH}$ sequence) sequences are $V_{HH}$ sequences, they may be suitably humanized, as further described herein. When the NANOBODIES® ($V_{HH}$ sequences) are partially humanized NANOBODIES® ($V_{HH}$ sequences), they may optionally be further suitably humanized, again as described herein.

In particular, a NANOBODY® ($V_{HH}$ sequence) of the invention can be an amino acid sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

i) (preferably) one or more of the amino acid residues at positions 11, 37, 44, 45, 47, 83, 84, 103, 104 and 108 according to the Kabat numbering are chosen from the Hallmark residues mentioned in Table B-2 (it being understood that $V_{HH}$ sequences will contain one or more Hallmark residues; and that partially humanized NANOBODIES® ($V_{HH}$ sequences) will usually, and preferably, contain one or more Hallmark residues [although it is also within the scope of the invention to provide—where suitable in accordance with the invention—partially humanized NANOBODIES® ($V_{HH}$ sequences) in which all Hallmark residues, but not one or more of the other amino acid residues, have been humanized]; and that in fully humanized NANOBODIES® ($V_{HH}$ sequences), where suitable in accordance with the invention, all amino acid residues at the positions of the Hallmark residues will be amino acid residues that occur in a human $V_H3$ sequence. As will be clear to the skilled person based on the disclosure herein that such $V_{HH}$ sequences, such partially humanized NANOBODIES® ($V_{HH}$ sequences) with at least one Hallmark residue, such partially humanized NANOBODIES® ($V_{HH}$ sequences) without Hallmark residues and such fully humanized NANOBODIES® ($V_{HH}$ sequences) all form aspects of this invention);

and in which:

ii) said amino acid sequence has at least 80% amino acid identity with at least one of the amino acid sequences of SEQ ID NO's: 1 to 22, in which for the purposes of determining the degree of amino acid identity, the amino acid residues that form the CDR sequences (indicated with X in the sequences of SEQ ID NO's: 1 to 22) are disregarded;

and in which:

iii) CDR1, CDR2 and CDR3 are as defined herein, and are preferably as defined according to one of the preferred aspects herein, and are more preferably as defined according to one of the more preferred aspects herein.

The above NANOBODIES® ($V_{HH}$ sequences) may for example be $V_{HH}$ sequences or may be humanized NANOBODIES® ($V_{HH}$ sequences). When the above NANOBODY® ($V_{HH}$ sequence) sequences are $V_{HH}$ sequences, they may be suitably humanized, as further described herein. When the NANOBODIES® ($V_{HH}$ sequences) are partially humanized NANOBODIES® ($V_{HH}$ sequences), they may optionally be further suitably humanized, again as described herein.

TABLE B-8

| Representative amino acid sequences for NANOBODIES® ($V_{HH}$ sequences) of the KERE, GLEW and P, R, S 103 group. The CDRs are indicated with XXXXX | | |
|---|---|---|
| KERE sequence no. 1 | SEQ ID NO: 1 | EVQLVESGGGLVQPGGSLRLSCAASGIPFSXXXXXWFRQAPGKQRDSVAXXXXXRFTISRDNAKNTVYLQM NSLKPEDTAVYRCYFXXXXXWGQGTQVTVSS |

TABLE B-8-continued

Representative amino acid sequences for NANOBODIES® ($V_{HH}$ sequences) of the KERE, GLEW and P, R, S 103 group. The CDRs are indicated with XXXXX

| | | |
|---|---|---|
| KERE sequence no. 2 | SEQ ID NO: 2 | QVKLEESGGGLVQAGGSLRLSCVGSGRTFSXXXXXWFRLAPGKEREFVAXXXXXRFTISRDTASNRGYLHM NNLTPEDTAVYYCAAXXXXXWGQGTQVTVSS |
| KERE sequence no. 3 | SEQ ID NO: 3 | AVQLVDSGGGLVQAGDSLKLSCALTGGAFTXXXXXWFRQTPGREREFVAXXXXXRFTISRDNAKNMVYLRM NSLIPEDAAVYSCAAXXXXXWGQGTLVTVSS |
| KERE sequence no. 4 | SEQ ID NO: 4 | QVQLVESGGGLVEAGGSLRLSCTASESPFRXXXXXWFRQTSGQEREFVAXXXXXRFTISRDDAKNTVWLHG STLKPEDTAVYYCAAXXXXXWGQGTQVTVSS |
| KERE sequence no. 5 | SEQ ID NO: 5 | AVQLVESGGGLVQGGGSLRLACAASERIFDXXXXXWYRQGPGNERELVAXXXXXRFTISMDYTKQTVYLHM NSLRPEDTGLYYCKIXXXXXWGQGTQVTVSS |
| KERE sequence no. 6 | SEQ ID NO: 6 | DVKFVESGGGLVQAGGSLRLSCVASGFNFDXXXXXWFRQAPGKEREEVAXXXXXRFTISSEKDKNSVYLQM NSLKPEDTALYICAGXXXXXWGRGTQVTVSS |
| KERE sequence no. 7 | SEQ ID NO: 7 | QVRLAESGGGLVQSGGSLRLSCVASGSTYTXXXXXWYRQYPGKQRALVAXXXXXRFTIARDSTKDTFCLQM NNLKPEDTAVYYCYAXXXXXWGQGTQVTVSS |
| KERE sequence no. 8 | SEQ ID NO: 8 | EVQLVESGGGLVQAGGSLRLSCAASGFTSDXXXXXWFRQAPGKPREGVSXXXXXRFTISTDNAKNTVHLLM NRVNAEDTALYYCAVXXXXXWGRGTRVIVSS |
| KERE sequence no. 9 | SEQ ID NO: 9 | QVQLVESGGGLVQPGGSLRLSCQASGDISTXXXXXWYRQVPGKLREFVAXXXXXRFTISGDNAKRAIYLQMN NLKPDDTAVYYCNRXXXXXWGQGTQVTVSP |
| KERE sequence no. 10 | SEQ ID NO: 10 | QVPVVESGGGLVQAGDSLRLFCAVPSFTSTXXXXXWFRQAPGKEREFVAXXXXXRFTISRNATKNTLTLRMD SLKPEDTAVYYCAAXXXXXWGQGTQVTVSS |
| KERE sequence no. 11 | SEQ ID NO: 11 | EVQLVESGGGLVQAGDSLRLFCTVSGGTASXXXXXWFRQAPGEKREFVAXXXXXRFTIARENAGNMVYLQM NNLKPDDTALYTCAAXXXXXWGRGTQVTVSS |
| KERE sequence no. 12 | SEQ ID NO: 12 | AVQLVESGGDSVQPGDSQTLSCAASGRTNSXXXXXWFRQAPGKERVFLAXXXXXRFTISRDSAKNMMY LQMNNLKPQDTAVYYCAAXXXXXWGQGTQVTVSS |
| KERE sequence no. 13 | SEQ ID NO: 13 | AVQLVESGGGLVQAGGSLRLSCVVSGLTSSXXXXXWFRQTPWQERDFVAXXXXXRFTISRDNYKDTVLL EMNFLKPEDTAIYYCAAXXXXXWGQGTQVTVSS |
| KERE sequence no. 14 | SEQ ID NO: 14 | AVQLVESGGGLVQAGASLRLSCATSTRTLDXXXXXWFRQAPGRDREFVAXXXXXRFTVSRDSAENTVAL QMNSLKPEDTAVYYCAAXXXXXWGQGTRVTVSS |
| KERE sequence no. 15 | SEQ ID NO: 15 | QVQLVESGGGLVQPGGSLRLSCTVSRLTAHXXXXXWFRQAPGKEREAVSXXXXXRFTISRDYAGNTAFL QMDSLKPEDTGVYYCATXXXXXWGQGTQVTVSS |
| KERE sequence no. 16 | SEQ ID NO: 16 | EVQLVESGGELVQAGGSLKLSCTASGRNFVXXXXXWFRRAPGKEREFVAXXXXXRFTVSRDNGKNTAY LRMNSLKPEDTADYYCAVXXXXXLGSGTQVTVSS |
| GLEW sequence no. 1 | SEQ ID NO: 17 | AVQLVESGGGLVQPGGSLRLSCAASGFTFSXXXXXWVRQAPGKVLEWVSXXXXXRFTISRDNAKNTLYL QMNSLKPEDTAVYYCVKXXXXXGSQGTQVTVSS |
| GLEW sequence no. 2 | SEQ ID NO: 18 | EVQLVESGGGLVQPGGSLRLSCVCVSSGCTXXXXXWVRQAPGKAEEWVSXXXXXRFKISRDNAKKTLY LQMNSLGPEDTAMYYCQRXXXXXRGQGTQVTVSS |
| GLEW sequence no. 3 | SEQ ID NO: 19 | EVQLVESGGGLALPGGSLTLSCVFSGSTFSXXXXXWVRHTPGKAEEWVSXXXXXRFTISRDNAKNTLYL EMNSLSPEDTAMYYCGRXXXXXRSKGIQVTVSS |
| P, R, S 103 sequence no. 1 | SEQ ID NO: 20 | AVQLVESGGGLVQAGGSLRLSCAASGRTFSXXXXXWFRQAPGKEREFVAXXXXXRFTISRDNAKNTVYL QMNSLKPEDTAVYYCAAXXXXXRGQGTQVTVSS |
| P, R, S 103 sequence no. 2 | SEQ ID NO: 21 | DVQLVESGGDLVQPGGSLRLSCAASGFSFDXXXXXWLRQTPGKGLEWVGXXXXXRFTISRDNAKNMLY LHLNNLKSEDTAVYYCRRXXXXXLGQGTQVTVSS |
| P, R, S 103 sequence no. 3 | SEQ ID NO: 22 | EVQLVESGGGLVQPGGSLRLSCVCVSSGCTXXXXXWVRQAPGKAEEWVSXXXXXRFKISRDNAKKTLY LQMNSLGPEDTAMYYCQRXXXXXRGQGTQVTVSS |

In particular, a NANOBODY® ($V_{HH}$ sequence) of the invention of the KERE group can be an amino acid sequence with the (general) structure

FR1-CDR1-FR2-CDR2-FR3-CDR3-FR4 in which:

i) the amino acid residue at position 45 according to the Kabat numbering is a charged amino acid (as defined herein) or a cysteine residue, and position 44 is preferably an E;

and in which:

ii) FR1 is an amino acid sequence that has at least 80% amino acid identity with at least one of the following amino acid sequences:

TABLE B-9

| Representative FW1 sequences for NANOBODIES® ($V_{HH}$ sequences) of the KERE-group. | | |
|---|---|---|
| KERE FW1 sequence no. 1 | SEQ ID NO: 23 | QVQRVESGGGLVQAGGSLRLSCAASGRTSS |
| KERE FW1 sequence no. 2 | SEQ ID NO: 24 | QVQLVESGGGLVQTGDSLSLSCSASGRTFS |
| KERE FW1 sequence no. 3 | SEQ ID NO: 25 | QVKLEESGGGLVQAGDSLRLSCAATGRAFG |
| KERE FW1 sequence no. 4 | SEQ ID NO: 26 | AVQLVESGGGLVQPGESLGLSCVASGRDFV |
| KERE FW1 sequence no. 5 | SEQ ID NO: 27 | EVQLVESGGGLVQAGGSLRLSCEVLGRTAG |
| KERE FW1 sequence no. 6 | SEQ ID NO: 28 | QVQLVESGGGWVQPGGSLRLSCAASETILS |
| KERE FW1 sequence no. 7 | SEQ ID NO: 29 | QVQLVESGGGTVQPGGSLNLSCVASGNTFN |
| KERE FW1 sequence no. 8 | SEQ ID NO: 30 | EVQLVESGGGLAQPGGSLQLSCSAPGFTLD |
| KERE FW1 sequence no. 9 | SEQ ID NO: 31 | AQELEESGGGLVQAGGSLRLSCAASGRTFN |

and in which:

iii) FR2 is an amino acid sequence that has at least 80% amino acid identity with at least one of the following amino acid sequences:

TABLE B-10

| Representative FW2 sequences for NANOBODIES® ($V_{HH}$ sequences) of the KERE-group. | | |
|---|---|---|
| KERE FW2 sequence no. 1 | SEQ ID NO: 41 | WFRQAPGKEREFVA |
| KERE FW2 sequence no. 2 | SEQ ID NO: 42 | WFRQTPGREREFVA |
| KERE FW2 sequence no. 3 | SEQ ID NO: 43 | WYRQAPGKQREMVA |
| KERE FW2 sequence no. 4 | SEQ ID NO: 44 | WYRQGPGKQRELVA |

TABLE B-10-continued

| Representative FW2 sequences for NANOBODIES® ($V_{HH}$ sequences) of the KERE-group. | | |
|---|---|---|
| KERE FW2 sequence no. 5 | SEQ ID NO: 45 | WIRQAPGKEREGVS |
| KERE FW2 sequence no. 6 | SEQ ID NO: 46 | WFREAPGKEREGIS |
| KERE FW2 sequence no. 7 | SEQ ID NO: 47 | WYRQAPGKERDLVA |
| KERE FW2 sequence no. 8 | SEQ ID NO: 48 | WFRQAPGKQREEVS |
| KERE FW2 sequence no. 9 | SEQ ID NO: 49 | WFRQPPGKVREFVG |

and in which:

iv) FR3 is an amino acid sequence that has at least 80% amino acid identity with at least one of the following amino acid sequences:

TABLE B-11

| Representative FW3 sequences for NANOBODIES® ($V_{HH}$ sequences) of the KERE-group. | | |
|---|---|---|
| ($V_{HH}$ sequences) of the K-ERE-group. | SEQ ID NO: 50 | RFTISRDNAKNTVYLQMNSLKPEDTAVYRCYF |
| KERE FW3 sequence no. 2 | SEQ ID NO: 51 | RFAISRDNNKNTGYLQMNSLEPEDTAVYYCAA |
| KERE FW3 sequence no. 3 | SEQ ID NO: 52 | RFTVARNNAKNTVNLEMNSLKPEDTAVYYCAA |
| KERE FW3 sequence no. 4 | SEQ ID NO: 53 | RFTISRDIAKNTVDLLMNNLEPEDTAVYYCAA |
| KERE FW3 sequence no. 5 | SEQ ID NO: 54 | RLTISRDNAVDTMYLQMNSLKPEDTAVYYCAA |
| KERE FW3 sequence no. 6 | SEQ ID NO: 55 | RFTISRDNAKNTVYLQMDNVKPEDTAIYYCAA |
| KERE FW3 sequence no. 7 | SEQ ID NO: 56 | RFTISKDSGKNTVYLQMTSLKPEDTAVYYCAT |
| KERE FW3 sequence no. 8 | SEQ ID NO: 57 | RFTISRDSAKNMMYLQMNNLKPQDTAVYYCAA |
| KERE FW3 sequence no. 9 | SEQ ID NO: 58 | RFTISRENDKSTVYLQLNSLKPEDTAVYYCAA |
| KERE FW3 sequence no. 10 | SEQ ID NO: 59 | RFTISRDYAGNTAYLQMNSLKPEDTGVYYCAT |

and in which:

v) FR4 is an amino acid sequence that has at least 80% amino acid identity with at least one of the following amino acid sequences:

TABLE B-12

| Representative FW4 sequences for NANOBODIES® ($V_{HH}$ sequences) of the KERE-group. | | |
|---|---|---|
| KERE FW4 sequence no. 1 | SEQ ID NO: 60 | WGQGTQVTVSS |
| KERE FW4 sequence no. 2 | SEQ ID NO: 61 | WGKGTLVTVSS |
| KERE FW4 sequence no. 3 | SEQ ID NO: 62 | RGQGTRVTVSS |
| KERE FW4 sequence no. 4 | SEQ ID NO: 63 | WGLGTQVTISS |

and in which:

vi) CDR1, CDR2 and CDR3 are as defined herein, and are preferably as defined according to one of the preferred aspects herein, and are more preferably as defined according to one of the more preferred aspects herein.

In the above NANOBODIES® ($V_{HH}$ sequences), one or more of the further Hallmark residues are preferably as described herein (for example, when they are $V_{HH}$ sequences or partially humanized NANOBODIES® ($V_{HH}$ sequences)).

Also, the above NANOBODIES® ($V_{HH}$ sequences) may for example be $V_{HH}$ sequences or may be humanized NANOBODIES® ($V_{HH}$ sequences). When the above NANOBODY® ($V_{HH}$ sequence) sequences are $V_{HH}$ sequences, they may be suitably humanized, as further described herein. When the NANOBODIES® ($V_{HH}$ sequences) are partially humanized NANOBODIES® ($V_{HH}$ sequences), they may optionally be further suitably humanized, again as described herein.

With regard to framework 1, it will be clear to the skilled person that, when an amino acid sequence as outlined above is generated by expression of a nucleotide sequence, the first four amino acid sequences (i.e. amino acid residues 1-4 according to the Kabat numbering) may often be determined by the primer(s) that have been used to generate said nucleic acid. Thus, for determining the degree of amino acid identity, the first four amino acid residues are preferably disregarded.

Also, with regard to framework 1, and although amino acid positions 27 to 30 are according to the Kabat numbering considered to be part of the framework regions (and not the CDR's), it has been found by analysis of a database of more than 1000 $V_{HH}$ sequences that the positions 27 to 30 have a variability (expressed in terms of $V_{HH}$ entropy and $V_{HH}$ variability—see Tables B-4 to B-7) that is much greater than the variability on positions 1 to 26. Because of this, for determining the degree of amino acid identity, the amino acid residues at positions 27 to 30 are preferably also disregarded.

In view of this, a NANOBODY® ($V_{HH}$ sequence) of the KERE class may be an amino acid sequence that is comprised of four framework regions/sequences interrupted by three complementarity determining regions/sequences, in which:

i) the amino acid residue at position 45 according to the Kabat numbering is a charged amino acid (as defined herein) or a cysteine residue, and position 44 is preferably an E;

and in which:

ii) FR1 is an amino acid sequence that, on positions 5 to 26 of the Kabat numbering, has at least 80% amino acid identity with at least one of the following amino acid sequences:

TABLE B-13

| Representative FW1 sequences (amino acid residues 5 to 26) for NANOBODIES® ($V_{HH}$ sequences) of the KERE-group. | | |
|---|---|---|
| KERE FW1 sequence no. 10 | SEQ ID NO: 32 | VESGGGLVQPGGSLRLSCAASG |
| KERE FW1 sequence no. 11 | SEQ ID NO: 33 | VDSGGGLVQAGDSLKLSCALTG |
| KERE FW1 sequence no. 12 | SEQ ID NO: 34 | VDSGGGLVQAGDSLRLSCAASG |
| KERE FW1 sequence no. 13 | SEQ ID NO: 35 | VDSGGGLVEAGGSLRLSCQVSE |
| KERE FW1 sequence no. 14 | SEQ ID NO: 36 | QDSGGGSVQAGGSLKLSCAASG |
| KERE FW1 sequence no. 15 | SEQ ID NO: 37 | VQSGGRLVQAGDSLRLSCAASE |
| KERE FW1 sequence no. 16 | SEQ ID NO: 38 | VESGGTLVQSGDSLKLSCASST |
| KERE FW1 sequence no. 17 | SEQ ID NO: 39 | MESGGDSVQSGGSLTLSCVASG |
| KERE FW1 sequence no. 18 | SEQ ID NO: 40 | QASGGGLVQAGGSLRLSCSASV |

and in which:

iii) FR2, FR3 and FR4 are as mentioned herein for FR2, FR3 and FR4 of NANOBODIES® ($V_{HH}$ sequences) of the KERE-class;

and in which:

iv) CDR1, CDR2 and CDR3 are as defined herein, and are preferably as defined according to one of the preferred aspects herein, and are more preferably as defined according to one of the more preferred aspects herein.

The above NANOBODIES® ($V_{HH}$ sequences) may for example be $V_{HH}$ sequences or may be humanized NANOBODIES® ($V_{HH}$ sequences). When the above NANOBODY® ($V_{HH}$ sequence) sequences are $V_{HH}$ sequences, they may be suitably humanized, as further described herein. When the NANOBODIES® ($V_{HH}$ sequences) are partially humanized NANOBODIES® ($V_{HH}$ sequences), they may optionally be further suitably humanized, again as described herein.

A NANOBODY® ($V_{HH}$ sequence) of the GLEW class may be an amino acid sequence that is comprised of four framework regions/sequences interrupted by three complementarity determining regions/sequences, in which i) preferably, when the NANOBODY® ($V_{HH}$ sequence) of the GLEW-class is a non-humanized NANOBODY® ($V_{HH}$ sequence), the amino acid residue in position 108 is Q;

ii) FR1 is an amino acid sequence that has at least 80% amino acid identity with at least one of the following amino acid sequences:

TABLE B-14

| Representative FW1 sequences for Nanobodies of the GLEW-group. | | |
|---|---|---|
| GLEW FW1 sequence no. 1 | SEQ ID NO: 64 | QVQLVESGGGLVQPGGSLRLSCAASGFTFS |
| GLEW FW1 sequence no. 2 | SEQ ID NO: 65 | EVHLVESGGGLVRPGGSLRLSCAAFGFIFK |
| GLEW FW1 sequence no. 3 | SEQ ID NO: 66 | QVKLEESGGGLAQPGGSLRLSCVASGFTFS |
| GLEW FW1 sequence no. 4 | SEQ ID NO: 67 | EVQLVESGGGLVQPGGSLRLSCVCVSSGCT |
| GLEW FW1 sequence no. 5 | SEQ ID NO: 68 | EVQLVESGGGLALPGGSLTLSCVFSGSTFS |

and in which:

iii) FR2 is an amino acid sequence that has at least 80% amino acid identity with at least one of the following amino acid sequences:

TABLE B-15

| Representative FW2 sequences for NANOBODIES® ($V_{HH}$ sequences) of the GLEW-group. | | |
|---|---|---|
| GLEW FW2 sequence no. 1 | SEQ ID NO: 72 | WVRQAPGKVLEWVS |
| GLEW FW2 sequence no. 2 | SEQ ID NO: 73 | WVRRPPGKGLEWVS |
| GLEW FW2 sequence no. 3 | SEQ ID NO: 74 | WVRQAPGMGLEWVS |
| GLEW FW2 sequence no. 4 | SEQ ID NO: 75 | WVRQAPGKEPEWVS |
| GLEW FW2 sequence no. 5 | SEQ ID NO: 76 | WVRQAPGKDQEWVS |
| GLEW FW2 sequence no. 6 | SEQ ID NO: 77 | WVRQAPGKAEEWVS |
| GLEW FW2 sequence no. 7 | SEQ ID NO: 78 | WVRQAPGKGLEWVA |
| GLEW FW2 sequence no. 8 | SEQ ID NO: 79 | WVRQAPGRATEWVS |

and in which:

iv) FR3 is an amino acid sequence that has at least 80% amino acid identity with at least one of the following amino acid sequences:

TABLE B-16

| Representative FW3 sequences for NANOBODIES® ($V_{HH}$ sequences) of the GLEW-group. | | |
|---|---|---|
| GLEW FW3 sequence no. 1 | SEQ ID NO: 80 | RFTISRDNAKNTLYLQMNSLKPEDTAVYYCVK |
| GLEW FW3 sequence no. 2 | SEQ ID NO: 81 | RFTISRDNARNTLYLQMDSLIPEDTALYYCAR |
| GLEW FW3 sequence no. 3 | SEQ ID NO: 82 | RFTSSRDNAKSTLYLQMNDLKPEDTALYYCAR |
| GLEW FW3 sequence no. 4 | SEQ ID NO: 83 | RFIISRDNAKNTLYLQMNSLGPEDTAMYYCQR |
| GLEW FW3 sequence no. 5 | SEQ ID NO: 84 | RFTASRDNAKNTLYLQMNSLKSEDTARYYCAR |
| GLEW FW3 sequence no. 6 | SEQ ID NO: 85 | RFTISRDNAKNTLYLQMDDLQSEDTAMYYCGR |

and in which:

v) FR4 is an amino acid sequence that has at least 80% amino acid identity with at least one of the following amino acid sequences:

TABLE B-17

| Representative FW4 sequences for NANOBODIES® ($V_{HH}$ sequences) of the GLEW-group. | | |
|---|---|---|
| GLEW FW4 sequence no. 1 | SEQ ID NO: 86 | GSQGTQVTVSS |
| GLEW FW4 sequence no. 2 | SEQ ID NO: 87 | LRGGTQVTVSS |
| GLEW FW4 sequence no. 3 | SEQ ID NO: 88 | RGQGTLVTVSS |
| GLEW FW4 sequence no. 4 | SEQ ID NO: 89 | RSRGIQVTVSS |
| GLEW FW4 sequence no. 5 | SEQ ID NO: 90 | WGKGTQVTVSS |
| GLEW FW4 sequence no. 6 | SEQ ID NO: 91 | WGQGTQVTVSS |

and in which:

vi) CDR1, CDR2 and CDR3 are as defined herein, and are preferably as defined according to one of the preferred aspects herein, and are more preferably as defined according to one of the more preferred aspects herein.

In the above NANOBODIES® ($V_{HH}$ sequences), one or more of the further Hallmark residues are preferably as described herein (for example, when they are $V_{HH}$ sequences or partially humanized NANOBODIES® ($V_{HH}$ sequences)).

With regard to framework 1, it will again be clear to the skilled person that, for determining the degree of amino acid identity, the amino acid residues on positions 1 to 4 and 27 to 30 are preferably disregarded.

In view of this, a NANOBODY® ($V_{HH}$ sequence) of the GLEW class may be an amino acid sequence that is comprised of four framework regions/sequences interrupted by three complementarity determining regions/sequences, in which:

i) preferably, when the NANOBODY® ($V_{HH}$ sequence) of the GLEW-class is a non-humanized NANOBODY® ($V_{HH}$ sequence), the amino acid residue in position 108 is Q;

and in which:

ii) FR1 is an amino acid sequence that, on positions 5 to 26 of the Kabat numbering, has at least 80% amino acid identity with at least one of the following amino acid sequences:

TABLE B-18

Representative FW1 sequences (amino acid residues 5 to 26) for NANOBODIES® ($V_{HH}$ sequences) KERE-group.

| | | |
|---|---|---|
| GLEW FW1 sequence no. 6 | SEQ ID NO: 69 | VESGGGLVQPGGSLRLSCAASG |
| GLEW FW1 sequence no. 7 | SEQ ID NO: 70 | EESGGGLAQPGGSLRLSCVASG |
| GLEW FW1 sequence no. 8 | SEQ ID NO: 71 | VESGGGLALPGGSLTLSCVFSG |

and in which:

iii) FR2, FR3 and FR4 are as mentioned herein for FR2, FR3 and FR4 of NANOBODIES® ($V_{HH}$ sequences) of the GLEW-class;

and in which:

iv) CDR1, CDR2 and CDR3 are as defined herein, and are preferably as defined according to one of the preferred aspects herein, and are more preferably as defined according to one of the more preferred aspects herein.

The above NANOBODIES® ($V_{HH}$ sequences) may for example be $V_{HH}$ sequences or may be humanized NANOBODIES® ($V_{HH}$ sequences). When the above NANOBODY® ($V_{HH}$ sequence) sequences are $V_{HH}$ sequences, they may be suitably humanized, as further described herein. When the NANOBODIES® ($V_{HH}$ sequences) are partially humanized NANOBODIES® ($V_{HH}$ sequences), they may optionally be further suitably humanized, again as described herein. In the above NANOBODIES® ($V_{HH}$ sequences), one or more of the further Hallmark residues are preferably as described herein (for example, when they are $V_{HH}$ sequences or partially humanized NANOBODIES® ($V_{HH}$ sequences)).

A NANOBODY® ($V_{HH}$ sequence) of the P, R, S 103 class may be an amino acid sequence that is comprised of four framework regions/sequences interrupted by three complementarity determining regions/sequences, in which i) the amino acid residue at position 103 according to the Kabat numbering is different from W;

and in which:

ii) preferably the amino acid residue at position 103 according to the Kabat numbering is P, R or S, and more preferably R;

and in which:

iii) FR1 is an amino acid sequence that has at least 80% amino acid identity with at least one of the following amino acid sequences:

TABLE B-19

Representative FW1 sequences for NANOBODIES® ($V_{HH}$ sequences) of the P, R, S 103-group.

| | | |
|---|---|---|
| P, R, S 103 FW1 sequence no. 1 | SEQ ID NO: 92 | AVQLVESGGGLVQAGGSLRLSCAASGRTFS |
| P, R, S 103 FW1 sequence no. 2 | SEQ ID NO: 93 | QVQLQESGGGMVQPGGSLRLSCAASGFDFG |
| P, R, S 103 FW1 sequence no. 3 | SEQ ID NO: 94 | EVHLVESGGGLVRPGGSLRLSCAAFGFIFK |
| P, R, S 103 FW1 sequence no. 4 | SEQ ID NO: 95 | QVQLAESGGGLVQPGGSLKLSCAASRTIVS |
| P, R, S 103 FW1 sequence no. 5 | SEQ ID NO: 96 | QEHLVESGGGLVDIGGSLRLSCAASERIFS |
| P, R, S 103 FW1 sequence no. 6 | SEQ ID NO: 97 | QVKLEESGGGLAQPGGSLRLSCVASGFTFS |
| P, R, S 103 FW1 sequence no. 7 | SEQ ID NO: 98 | EVQLVESGGGLVQPGGSLRLSCVCVSSGCT |
| P, R, S 103 FW1 sequence no. 8 | SEQ ID NO: 99 | EVQLVESGGGLALPGGSLTLSCVFSGSTFS |

and in which iv) FR2 is an amino acid sequence that has at least 80% amino acid identity with at least one of the following amino acid sequences:

TABLE B-20

Representative FW2 sequences for NANOBODIES® ($V_{HH}$ sequences) of the P, R, S 103-group.

| | | |
|---|---|---|
| P, R, S 103 FW2 sequence no. 1 | SEQ ID NO: 102 | WFRQAPGKEREFVA |
| P, R, S 103 FW2 sequence no. 2 | SEQ ID NO: 103 | WVRQAPGKVLEWVS |
| P, R, S 103 FW2 sequence no. 3 | SEQ ID NO: 104 | WVRRPPGKGLEWVS |
| P, R, S 103 FW2 sequence no. 4 | SEQ ID NO: 105 | WIRQAPGKEREGVS |

TABLE B-20-continued

| Representative FW2 sequences for NANOBODIES® ($V_{HH}$ sequences) of the P, R, S 103-group. | | |
|---|---|---|
| P, R, S 103 FW2 sequence no. 5 | SEQ ID NO: 106 | WVRQYPGKEPEWVS |
| P, R, S 103 FW2 sequence no. 6 | SEQ ID NO: 107 | WFRQPPGKEHEFVA |
| P, R, S 103 FW2 sequence no. 7 | SEQ ID NO: 108 | WYRQAPGKRTELVA |
| P, R, S 103 FW2 sequence no. 8 | SEQ ID NO: 109 | WLRQAPGQGLEWVS |
| P, R, S 103 FW2 sequence no. 9 | SEQ ID NO: 110 | WLRQTPGKGLEWVG |
| P, R, S 103 FW2 sequence no. 10 | SEQ ID NO: 111 | WVRQAPGKAEEFVS |

and in which:

v) FR3 is an amino acid sequence that has at least 80% amino acid identity with at least one of the following amino acid sequences:

TABLE B-21

| Representative FW3 sequences for NANOBODIES® ($V_{HH}$ sequences) of the P, R, S 103-group. | | |
|---|---|---|
| P, R, S 103 FW3 sequence no. 1 | SEQ ID NO: 112 | RFTISRDNAKNTVYLQMNSLKPEDTAVYYCAA |
| P, R, S 103 FW3 sequence no. 2 | SEQ ID NO: 113 | RFTISRDNARNTLYLQMDSLIPEDTALYYCAR |
| P, R, S 103 FW3 sequence no. 3 | SEQ ID NO: 114 | RFTISRDNAKNEMYLQMNNLKTEDTGVYWCGA |
| P, R, S 103 FW3 sequence no. 4 | SEQ ID NO: 115 | RFTISSDSNRNMIYLQMNNLKPEDTAVYYCAA |
| P, R, S 103 FW3 sequence no. 5 | SEQ ID NO: 116 | RFTISRDNAKNMLYLHLNNLKSEDTAVYYCRR |
| P, R, S 103 FW3 sequence no. 6 | SEQ ID NO: 117 | RFTISRDNAKKTVYLRLNSLNPEDTAVYSCNL |
| P, R, S 103 FW3 sequence no. 7 | SEQ ID NO: 118 | RFKISRDNAKKTLYLQMNSLGPEDTAMYYCQR |
| P, R, S 103 FW3 sequence no. 8 | SEQ ID NO: 119 | RFTVSRDNGKNTAYLRMNSLKPEDTADYYCAV |

and in which:

vi) FR4 is an amino acid sequence that has at least 80% amino acid identity with at least one of the following amino acid sequences:

TABLE B-22

| Representative FW4 sequences for NANOBODIES® ($V_{HH}$ sequences) of the P, R, S 103-group. | | |
|---|---|---|
| P, R, S 103 FW4 sequence no. 1 | SEQ ID NO: 120 | RGQGTQVTVSS |
| P, R, S 103 FW4 sequence no. 2 | SEQ ID NO: 121 | LRGGTQVTVSS |
| P, R, S 103 FW4 sequence no. 3 | SEQ ID NO: 122 | GNKGTLVTVSS |
| P, R, S 103 FW4 sequence no. 4 | SEQ ID NO: 123 | SSPGTQVTVSS |
| P, R, S 103 FW4 sequence no. 5 | SEQ ID NO: 124 | SSQGTLVTVSS |
| P, R, S 103 FW4 sequence no. 6 | SEQ ID NO: 125 | RSRGIQVTVSS |

and in which:

vii) CDR1, CDR2 and CDR3 are as defined herein, and are preferably as defined according to one of the preferred aspects herein, and are more preferably as defined according to one of the more preferred aspects herein.

In the above NANOBODIES® ($V_{HH}$ sequences), one or more of the further Hallmark residues are preferably as described herein (for example, when they are $V_{HH}$ sequences or partially humanized NANOBODIES® ($V_{HH}$ sequences)).

With regard to framework 1, it will again be clear to the skilled person that, for determining the degree of amino acid identity, the amino acid residues on positions 1 to 4 and 27 to 30 are preferably disregarded.

In view of this, a NANOBODY® ($V_{HH}$ sequence) of the P,R,S 103 class may be an amino acid sequence that is comprised of four framework regions/sequences interrupted by three complementarity determining regions/sequences, in which:

i) the amino acid residue at position 103 according to the Kabat numbering is different from W;

and in which:

ii) preferably the amino acid residue at position 103 according to the Kabat numbering is P, R or S, and more preferably R;

and in which:

iii) FR1 is an amino acid sequence that, on positions 5 to 26 of the Kabat numbering, has at least 80% amino acid identity with at least one of the following amino acid sequences:

TABLE B-23

| Representative FW1 sequences (amino acid residues 5 to 26) for NANOBODIES® ($V_{HH}$ sequences) of the P, R, S 103-group. | | |
|---|---|---|
| P, R, S 103 FW1 sequence no. 9 | SEQ ID NO: 100 | VESGGGLVQAGGSLRLSCAASG |
| P, R, S 103 FW1 sequence no. 10 | SEQ ID NO: 101 | AESGGGLVQPGGSLKLSCAASR |

and in which:

iv) FR2, FR3 and FR4 are as mentioned herein for FR2, FR3 and FR4 of NANOBODIES® ($V_{HH}$ sequences) of the P,R,S 103 class;

and in which:

v) CDR1, CDR2 and CDR3 are as defined herein, and are preferably as defined according to one of the preferred aspects herein, and are more preferably as defined according to one of the more preferred aspects herein.

The above NANOBODIES® ($V_{HH}$ sequences) may for example be $V_{HH}$ sequences or may be humanized NANOBODIES® ($V_{HH}$ sequences). When the above NANOBODY® ($V_{HH}$ sequence) sequences are $V_{HH}$ sequences, they may be suitably humanized, as further described herein. When the NANOBODIES® ($V_{HH}$ sequences) are partially humanized NANOBODIES® ($V_{HH}$ sequences), they may optionally be further suitably humanized, again as described herein.

In the above NANOBODIES® ($V_{HH}$ sequences), one or more of the further Hallmark residues are preferably as described herein (for example, when they are $V_{HH}$ sequences or partially humanized NANOBODIES® ($V_{HH}$ sequences)).

In another preferred, but non-limiting aspect, the invention relates to a NANOBODY® ($V_{HH}$ sequence) as described above, in which the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 126 to 407, 2431 to 2448, 2574 to 2581, 2682 to 2717 and 3064 to 3128 (see Table A-1). This degree of amino acid identity can for example be determined by determining the degree of amino acid identity (in a manner described herein) between said NANOBODY® ($V_{HH}$ sequence) and one or more of the sequences of SEQ ID NO's: 126 to 407, 2431 to 2448, 2574 to 2581, 2682 to 2717 and 3064 to 3128 (see Table A-1), in which the amino acid residues that form the framework regions are disregarded. Such NANOBODIES® ($V_{HH}$ sequences) can be as further described herein.

As already mentioned herein, another preferred but non-limiting aspect of the invention relates to a NANOBODY® ($V_{HH}$ sequence) with an amino acid sequence that is chosen from the group consisting of SEQ ID NO's: 126 to 407, 2431 to 2448, 2574 to 2581, 2682 to 2717 and 3064 to 3128 (see Table A-1) or from the group consisting of from amino acid sequences that have more than 80%, preferably more than 90%, more preferably more than 95%, such as 99% or more sequence identity (as defined herein) with at least one of the amino acid sequences of SEQ ID NO's: 126 to 407, 2431 to 2448, 2574 to 2581, 2682 to 2717 and 3064 to 3128 (see Table A-1).

Also, in the above NANOBODIES® ($V_{HH}$ sequences):

i) any amino acid substitution (when it is not a humanizing substitution as defined herein) is preferably, and compared to the corresponding amino acid sequence of SEQ ID NO's: 126 to 407, 2431 to 2448, 2574 to 2581, 2682 to 2717 and 3064 to 3128 (see Table A-1), a conservative amino acid substitution, (as defined herein);

and/or:

ii) its amino acid sequence preferably contains either only amino acid substitutions, or otherwise preferably no more than 5, preferably no more than 3, and more preferably only 1 or 2 amino acid deletions or insertions, compared to the corresponding amino acid sequence of SEQ ID NO's: 126 to 407, 2431 to 2448, 2574 to 2581, 2682 to 2717 and 3064 to 3128 (see Table A-1);

and/or iii) the CDR's may be CDR's that are derived by means of affinity maturation, for example starting from the CDR's of to the corresponding amino acid sequence of SEQ ID NO's: 126 to 407, 2431 to 2448, 2574 to 2581, 2682 to 2717 and 3064 to 3128 (see Table A-1).

Preferably, the CDR sequences and FR sequences in the NANOBODIES® ($V_{HH}$ sequences) of the invention are such that the NANOBODIES® ($V_{HH}$ sequences) of the invention (and polypeptides of the invention comprising the same):

bind to an envelope protein of a virus with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);

and/or such that they:

bind to an envelope protein of a virus with a $k_{on}$-rate of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$;

and/or such that they:

bind to an envelope protein of a virus with a $k_{off}$ rate between 1 $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Preferably, CDR sequences and FR sequences present in the NANOBODIES® ($V_{HH}$ sequences) of the invention are such that the Nanobodies of the invention will bind to an envelope protein of a virus with an affinity less than 500 nM, preferably less than 200 nM, more preferably less than 10 nM, such as less than 500 pM.

According to one non-limiting aspect of the invention, a NANOBODY® ($V_{HH}$ sequence) may be as defined herein, but with the proviso that it has at least "one amino acid difference" (as defined herein) in at least one of the framework regions compared to the corresponding framework region of a naturally occurring human $V_H$ domain, and in particular compared to the corresponding framework region of DP-47. More specifically, according to one non-limiting aspect of the invention, a NANOBODY® ($V_{HH}$ sequence) may be as defined herein, but with the proviso that it has at least "one amino acid difference" (as defined herein) at at least one of the Hallmark residues (including those at positions 108, 103 and/or 45) compared to the corresponding framework region of a naturally occurring human $V_H$ domain, and in particular compared to the corresponding framework region of DP-47. Usually, a NANOBODY® ($V_{HH}$ sequence) will have at least one such amino acid difference with a naturally occurring $V_H$ domain in at least one of FR2 and/or FR4, and in particular at at least one of the Hallmark residues in FR2 and/or FR4 (again, including those at positions 108, 103 and/or 45).

Also, a humanized NANOBODY® ($V_{HH}$ sequence) of the invention may be as defined herein, but with the proviso that it has at least "one amino acid difference" (as defined herein) in at least one of the framework regions compared to the corresponding framework region of a naturally occurring $V_{HH}$ domain. More specifically, according to one non-limiting aspect of the invention, a humanized NANOBODY® ($V_{HH}$ sequence) may be as defined herein, but with the proviso that it has at least "one amino acid difference" (as defined herein) at at least one of the Hallmark residues (including those at positions 108, 103 and/or 45) compared to the corresponding framework region of a naturally occurring $V_{HH}$ domain. Usually, a humanized NANOBODY® ($V_{HH}$ sequence) will have at least one such amino acid difference with a naturally occurring $V_{HH}$ domain in at least one of FR2 and/or FR4, and in particular at at least one of the Hallmark residues in FR2 and/or FR4 (again, including those at positions 108, 103 and/or 45).

As will be clear from the disclosure herein, it is also within the scope of the invention to use natural or synthetic analogs, mutants, variants, alleles, homologs and orthologs (herein collectively referred to as "analogs") of the NANOBODIES® ($V_{HH}$ sequences) of the invention as defined herein, and in particular analogs of the NANOBODIES® ($V_{HH}$ sequences) of SEQ ID NO's: 126 to 407, 2431 to 2448, 2574 to 2581, 2682 to 2717 and 3064 to 3128 (see Table A-1). Thus, according to one aspect of the invention, the term "NANOBODY® ($V_{HH}$ sequence) of the invention" in its broadest sense also covers such analogs.

Generally, in such analogs, one or more amino acid residues may have been replaced, deleted and/or added, compared to the NANOBODIES® ($V_{HH}$ sequences) of the invention as defined herein. Such substitutions, insertions or deletions may be made in one or more of the framework regions and/or in one or more of the CDR's. When such substitutions, insertions or deletions are made in one or more of the framework regions, they may be made at one or more of the Hallmark residues and/or at one or more of the other positions in the framework residues, although substitutions, insertions or deletions at the Hallmark residues are generally less preferred (unless these are suitable humanizing substitutions as described herein).

By means of non-limiting examples, a substitution may for example be a conservative substitution (as described herein) and/or an amino acid residue may be replaced by another amino acid residue that naturally occurs at the same position in another $V_{HH}$ domain (see Tables B-4 to B-7 for some non-limiting examples of such substitutions), although the invention is generally not limited thereto. Thus, any one or more substitutions, deletions or insertions, or any combination thereof, that either improve the properties of the NANOBODY® ($V_{HH}$ sequence) of the invention or that at least do not detract too much from the desired properties or from the balance or combination of desired properties of the NANOBODY® ($V_{HH}$ sequence) of the invention (i.e. to the extent that the NANOBODY® ($V_{HH}$ sequence) is no longer suited for its intended use) are included within the scope of the invention. A skilled person will generally be able to determine and select suitable substitutions, deletions or insertions, or suitable combinations of thereof, based on the disclosure herein and optionally after a limited degree of routine experimentation, which may for example involve introducing a limited number of possible substitutions and determining their influence on the properties of the NANOBODIES® ($V_{HH}$ sequences) thus obtained.

For example, and depending on the host organism used to express the NANOBODY® ($V_{HH}$ sequence) or polypeptide of the invention, such deletions and/or substitutions may be designed in such a way that one or more sites for post-translational modification (such as one or more glycosylation sites or myristilation sites) are removed, as will be within the ability of the person skilled in the art. Alternatively, substitutions or insertions may be designed so as to introduce one or more sites for attachment of functional groups (as described herein), for example to allow site-specific pegylation (again as described herein).

As can be seen from the data on the $V_{HH}$ entropy and $V_{HH}$ variability given in Tables B-4 to B-7 above, some amino acid residues in the framework regions are more conserved than others. Generally, although the invention in its broadest sense is not limited thereto, any substitutions, deletions or insertions are preferably made at positions that are less conserved. Also, generally, amino acid substitutions are preferred over amino acid deletions or insertions.

The analogs are preferably such that they can bind to an envelope protein of a virus with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein for the NANOBODIES® ($V_{HH}$ sequences) of the invention.

The analogs are preferably also such that they retain the favourable properties the NANOBODIES® ($V_{HH}$ sequences), as described herein.

Also, according to one preferred aspect, the analogs have a degree of sequence identity of at least 70%, preferably at least 80%, more preferably at least 90%, such as at least 95% or 99% or more; and/or preferably have at most 20, preferably at most 10, even more preferably at most 5, such as 4, 3, 2 or only 1 amino acid difference (as defined herein), with one of the NANOBODIES® ($V_{HH}$ sequences) of SEQ ID NO's: 126 to 407, 2431 to 2448, 2574 to 2581, 2682 to 2717 and 3064 to 3128 (see Table A-1).

Also, the framework sequences and CDR's of the analogs are preferably such that they are in accordance with the preferred aspects defined herein. More generally, as described herein, the analogs will have (a) a Q at position 108; and/or (b) a charged amino acid or a cysteine residue at position 45 and preferably an E at position 44, and more preferably E at position 44 and R at position 45; and/or (c) P, R or S at position 103.

One preferred class of analogs of the NANOBODIES® ($V_{HH}$ sequences) of the invention comprise NANOBODIES® ($V_{HH}$ sequences) that have been humanized (i.e. compared to the sequence of a naturally occurring NANOBODY® ($V_{HH}$ sequence) of the invention). As mentioned in the background art cited herein, such humanization generally involves replacing one or more amino acid residues in the sequence of a naturally occurring $V_{HH}$ with the amino acid residues that occur at the same position in a human $V_H$ domain, such as a human $V_H3$ domain. Examples of possible humanizing substitutions or combinations of humanizing substitutions will be clear to the skilled person, for example from the Tables herein, from the possible humanizing substitutions mentioned in the background art cited herein, and/or from a comparison between the sequence of a NANOBODY® ($V_{HH}$ sequence) and the sequence of a naturally occurring human $V_H$ domain.

The humanizing substitutions should be chosen such that the resulting humanized NANOBODIES® ($V_{HH}$ sequences)

still retain the favourable properties of NANOBODIES® ($V_{HH}$ sequences) as defined herein, and more preferably such that they are as described for analogs in the preceding paragraphs. A skilled person will generally be able to determine and select suitable humanizing substitutions or suitable combinations of humanizing substitutions, based on the disclosure herein and optionally after a limited degree of routine experimentation, which may for example involve introducing a limited number of possible humanizing substitutions and determining their influence on the properties of the NANOBODIES® ($V_{HH}$ sequences) thus obtained.

Generally, as a result of humanization, the NANOBODIES® ($V_{HH}$ sequences) of the invention may become more "human-like", while still retaining the favorable properties of the NANOBODIES® ($V_{HH}$ sequences) of the invention as described herein. As a result, such humanized NANOBODIES® ($V_{HH}$ sequences) may have several advantages, such as a reduced immunogenicity, compared to the corresponding naturally occurring $V_{HH}$ domains. Again, based on the disclosure herein and optionally after a limited degree of routine experimentation, the skilled person will be able to select humanizing substitutions or suitable combinations of humanizing substitutions which optimize or achieve a desired or suitable balance between the favourable properties provided by the humanizing substitutions on the one hand and the favourable properties of naturally occurring $V_{HH}$ domains on the other hand.

The NANOBODIES® ($V_{HH}$ sequences) of the invention may be suitably humanized at any framework residue(s), such as at one or more Hallmark residues (as defined herein) or at one or more other framework residues (i.e. non-Hallmark residues) or any suitable combination thereof. One preferred humanizing substitution for NANOBODIES® ($V_{HH}$ sequences) of the "P,R,S-103 group" or the "KERE group" is Q108 into L108. NANOBODIES® ($V_{HH}$ sequences) of the "GLEW class" may also be humanized by a Q108 into L108 substitution, provided at least one of the other Hallmark residues contains a camelid (camelizing) substitution (as defined herein). For example, as mentioned above, one particularly preferred class of humanized NANOBODIES® ($V_{HH}$ sequences) has GLEW or a GLEW-like sequence at positions 44-47; P, R or S (and in particular R) at position 103, and an L at position 108.

The humanized and other analogs, and nucleic acid sequences encoding the same, can be provided in any manner known per se, for example using one or more of the techniques mentioned on pages 103 and 104 of WO 08/020079.

As mentioned there, it will be also be clear to the skilled person that the NANOBODIES® ($V_{HH}$ sequences) of the invention (including their analogs) can be designed and/or prepared starting from human $V_H$ sequences (i.e. amino acid sequences or the corresponding nucleotide sequences), such as for example from human $V_H3$ sequences such as DP-47, DP-51 or DP-29, i.e. by introducing one or more camelizing substitutions (i.e. changing one or more amino acid residues in the amino acid sequence of said human $V_H$ domain into the amino acid residues that occur at the corresponding position in a $V_{HH}$ domain), so as to provide the sequence of a NANOBODY® ($V_{HH}$ sequence) of the invention and/or so as to confer the favourable properties of a NANOBODY® ($V_{HH}$ sequence) to the sequence thus obtained. Again, this can generally be performed using the various methods and techniques referred to in the previous paragraph, using an amino acid sequence and/or nucleotide sequence for a human $V_H$ domain as a starting point.

Some preferred, but non-limiting camelizing substitutions can be derived from Tables B-4 to B-7. It will also be clear that camelizing substitutions at one or more of the Hallmark residues will generally have a greater influence on the desired properties than substitutions at one or more of the other amino acid positions, although both and any suitable combination thereof are included within the scope of the invention. For example, it is possible to introduce one or more camelizing substitutions that already confer at least some the desired properties, and then to introduce further camelizing substitutions that either further improve said properties and/or confer additional favourable properties. Again, the skilled person will generally be able to determine and select suitable camelizing substitutions or suitable combinations of camelizing substitutions, based on the disclosure herein and optionally after a limited degree of routine experimentation, which may for example involve introducing a limited number of possible camelizing substitutions and determining whether the favourable properties of NANOBODIES® ($V_{HH}$ sequences) are obtained or improved (i.e. compared to the original $V_H$ domain).

Generally, however, such camelizing substitutions are preferably such that the resulting amino acid sequence at least contains (a) a Q at position 108; and/or (b) a charged amino acid or a cysteine residue at position 45 and preferably also an E at position 44, and more preferably E at position 44 and R at position 45; and/or (c) P, R or S at position 103; and optionally one or more further camelizing substitutions. More preferably, the camelizing substitutions are such that they result in a NANOBODY® ($V_{HH}$ sequence) of the invention and/or in an analog thereof (as defined herein), such as in a humanized analog and/or preferably in an analog that is as defined in the preceding paragraphs.

As will also be clear from the disclosure herein, it is also within the scope of the invention to use parts or fragments, or combinations of two or more parts or fragments, of the NANOBODIES® ($V_{HH}$ sequences) of the invention as defined herein, and in particular parts or fragments of the NANOBODIES® ($V_{HH}$ sequences) of SEQ ID NO's: 126 to 407, 2431 to 2448, 2574 to 2581, 2682 to 2717 and 3064 to 3128 (see Table A-1). Thus, according to one aspect of the invention, the term "NANOBODY® ($V_{HH}$ sequence) of the invention" in its broadest sense also covers such parts or fragments.

Generally, such parts or fragments of the NANOBODIES® ($V_{HH}$ sequences) of the invention (including analogs thereof) have amino acid sequences in which, compared to the amino acid sequence of the corresponding full length NANOBODY® ($V_{HH}$ sequence) of the invention (or analog thereof), one or more of the amino acid residues at the N-terminal end, one or more amino acid residues at the C-terminal end, one or more contiguous internal amino acid residues, or any combination thereof, have been deleted and/or removed.

The parts or fragments are preferably such that they can bind to an envelope protein of a virus with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein for the NANOBODIES® ($V_{HH}$ sequences) of the invention.

Any part or fragment is preferably such that it comprises at least 10 contiguous amino acid residues, preferably at least 20 contiguous amino acid residues, more preferably at least 30 contiguous amino acid residues, such as at least 40 contiguous amino acid residues, of the amino acid sequence of the corresponding full length NANOBODY® ($V_{HH}$ sequence) of the invention.

Also, any part or fragment is such preferably that it comprises at least one of CDR1, CDR2 and/or CDR3 or at least part thereof (and in particular at least CDR3 or at least part thereof). More preferably, any part or fragment is such that it comprises at least one of the CDR's (and preferably at least CDR3 or part thereof) and at least one other CDR (i.e. CDR1 or CDR2) or at least part thereof, preferably connected by suitable framework sequence(s) or at least part thereof. More preferably, any part or fragment is such that it comprises at least one of the CDR's (and preferably at least CDR3 or part thereof) and at least part of the two remaining CDR's, again preferably connected by suitable framework sequence(s) or at least part thereof.

According to another particularly preferred, but non-limiting aspect, such a part or fragment comprises at least CDR3, such as FR3, CDR3 and FR4 of the corresponding full length NANOBODY® ($V_{HH}$ sequence) of the invention, i.e. as for example described in the International application WO 03/050531 (Lasters et al.).

As already mentioned above, it is also possible to combine two or more of such parts or fragments (i.e. from the same or different NANOBODIES® ($V_{HH}$ sequences) of the invention), i.e. to provide an analog (as defined herein) and/or to provide further parts or fragments (as defined herein) of a NANOBODY® ($V_{HH}$ sequence) of the invention. It is for example also possible to combine one or more parts or fragments of a NANOBODY® ($V_{HH}$ sequence) of the invention with one or more parts or fragments of a human $V_H$ domain.

According to one preferred aspect, the parts or fragments have a degree of sequence identity of at least 50%, preferably at least 60%, more preferably at least 70%, even more preferably at least 80%, such as at least 90%, 95% or 99% or more with one of the NANOBODIES® ($V_{HH}$ sequences) of SEQ ID NO's: 126 to 407, 2431 to 2448, 2574 to 2581, 2682 to 2717 and 3064 to 3128 (see Table A-1).

The parts and fragments, and nucleic acid sequences encoding the same, can be provided and optionally combined in any manner known per se. For example, such parts or fragments can be obtained by inserting a stop codon in a nucleic acid that encodes a full-sized NANOBODY® ($V_{HH}$ sequence) of the invention, and then expressing the nucleic acid thus obtained in a manner known per se (e.g. as described herein). Alternatively, nucleic acids encoding such parts or fragments can be obtained by suitably restricting a nucleic acid that encodes a full-sized NANOBODY® ($V_{HH}$ sequence) of the invention or by synthesizing such a nucleic acid in a manner known per se. Parts or fragments may also be provided using techniques for peptide synthesis known per se.

The invention in its broadest sense also comprises derivatives of the NANOBODIES® ($V_{HH}$ sequences) of the invention. Such derivatives can generally be obtained by modification, and in particular by chemical and/or biological (e.g. enzymatical) modification, of the NANOBODIES® ($V_{HH}$ sequences) of the invention and/or of one or more of the amino acid residues that form the NANOBODIES® ($V_{HH}$ sequences) of the invention.

Examples of such modifications, as well as examples of amino acid residues within the NANOBODY® ($V_{HH}$ sequence) sequence that can be modified in such a manner (i.e. either on the protein backbone but preferably on a side chain), methods and techniques that can be used to introduce such modifications and the potential uses and advantages of such modifications will be clear to the skilled person.

For example, such a modification may involve the introduction (e.g. by covalent linking or in an other suitable manner) of one or more functional groups, residues or moieties into or onto the NANOBODY® ($V_{HH}$ sequence) of the invention, and in particular of one or more functional groups, residues or moieties that confer one or more desired properties or functionalities to the NANOBODY® ($V_{HH}$ sequence) of the invention. Example of such functional groups will be clear to the skilled person.

For example, such modification may comprise the introduction (e.g. by covalent binding or in any other suitable manner) of one or more functional groups that increase the half-life, the solubility and/or the absorption of the NANOBODY® ($V_{HH}$ sequence) of the invention, that reduce the immunogenicity and/or the toxicity of the NANOBODY® ($V_{HH}$ sequence) of the invention, that eliminate or attenuate any undesirable side effects of the NANOBODY® ($V_{HH}$ sequence) of the invention, and/or that confer other advantageous properties to and/or reduce the undesired properties of the NANOBODIES® ($V_{HH}$ sequences) and/or polypeptides of the invention; or any combination of two or more of the foregoing. Examples of such functional groups and of techniques for introducing them will be clear to the skilled person, and can generally comprise all functional groups and techniques mentioned in the general background art cited hereinabove as well as the functional groups and techniques known per se for the modification of pharmaceutical proteins, and in particular for the modification of antibodies or antibody fragments (including ScFv's and single domain antibodies), for which reference is for example made to Remington's Pharmaceutical Sciences, 16th ed., Mack Publishing Co., Easton, Pa. (1980). Such functional groups may for example be linked directly (for example covalently) to a NANOBODY® ($V_{HH}$ sequence) of the invention, or optionally via a suitable linker or spacer, as will again be clear to the skilled person.

One of the most widely used techniques for increasing the half-life and/or reducing the immunogenicity of pharmaceutical proteins comprises attachment of a suitable pharmacologically acceptable polymer, such as poly(ethyleneglycol) (PEG) or derivatives thereof (such as methoxypoly(ethyleneglycol) or mPEG). Generally, any suitable form of pegylation can be used, such as the pegylation used in the art for antibodies and antibody fragments (including but not limited to (single) domain antibodies and ScFv's); reference is made to for example Chapman, Nat. Biotechnol., 54, 531-545 (2002); Veronese and Harris (2002) Adv. Drug Deliv. Rev. 54: 453-456, Harris and Chess, Nat. Rev. Drug. Discov., 2, (2003) and in WO 04/060965. Various reagents for pegylation of proteins are also commercially available, for example from Nektar Therapeutics, USA.

Preferably, site-directed pegylation is used, in particular via a cysteine-residue (see for example Yang et al., Protein Engineering, 16, 10, 761-770 (2003). For example, for this purpose, PEG may be attached to a cysteine residue that naturally occurs in a NANOBODY® ($V_{HH}$ sequence) of the invention, a NANOBODY® ($V_{HH}$ sequence) of the invention may be modified so as to suitably introduce one or more cysteine residues for attachment of PEG, or an amino acid sequence comprising one or more cysteine residues for attachment of PEG may be fused to the N- and/or C-terminus of a NANOBODY® ($V_{HH}$ sequence) of the invention, all using techniques of protein engineering known per se to the skilled person.

Preferably, for the NANOBODIES® ($V_{HH}$ sequences) and proteins of the invention, a PEG is used with a molecular weight of more than 5000, such as more than 10,000 and less than 200,000, such as less than 100,000; for example in the range of 20,000-80,000.

Another, usually less preferred modification comprises N-linked or O-linked glycosylation, usually as part of co-translational and/or post-translational modification, depending on the host cell used for expressing the NANOBODY® ($V_{HH}$ sequence) or polypeptide of the invention.

An also usually less preferred modification comprises myristilation, usually as part of co-translational and/or post-translational modification, depending on the host cell used for expressing the NANOBODY® ($V_{HH}$ sequence) or polypeptide of the invention.

Yet another modification may comprise the introduction of one or more detectable labels or other signal-generating groups or moieties, depending on the intended use of the labelled NANOBODY® ($V_{HH}$ sequence). Suitable labels and techniques for attaching, using and detecting them will be clear to the skilled person, and for example include, but are not limited to, the fluorescent labels, phosphorescent labels, chemiluminescent labels, bioluminescent labels, radio-isotopes, metals, metal chelates, metallic cations, chromophores and enzymes, such as those mentioned on page 109 of WO 08/020079. Other suitable labels will be clear to the skilled person, and for example include moieties that can be detected using NMR or ESR spectroscopy.

Such labelled NANOBODIES® ($V_{HH}$ sequences) and polypeptides of the invention may for example be used for in vitro, in vivo or in situ assays (including immunoassays known per se such as ELISA, RIA, EIA and other "sandwich assays", etc.) as well as in vivo diagnostic and imaging purposes, depending on the choice of the specific label.

As will be clear to the skilled person, another modification may involve the introduction of a chelating group, for example to chelate one of the metals or metallic cations referred to above. Suitable chelating groups for example include, without limitation, diethyl-enetriaminepentaacetic acid (DTPA) or ethylenediaminetetraacetic acid (EDTA).

Yet another modification may comprise the introduction of a functional group that is one part of a specific binding pair, such as the biotin-(strept)avidin binding pair. Such a functional group may be used to link the NANOBODY® ($V_{HH}$ sequence) of the invention to another protein, polypeptide or chemical compound that is bound to the other half of the binding pair, i.e. through formation of the binding pair. For example, a NANOBODY® ($V_{HH}$ sequence) of the invention may be conjugated to biotin, and linked to another protein, polypeptide, compound or carrier conjugated to avidin or streptavidin. For example, such a conjugated NANOBODY® ($V_{HH}$ sequence) may be used as a reporter, for example in a diagnostic system where a detectable signal-producing agent is conjugated to avidin or streptavidin. Such binding pairs may for example also be used to bind the NANOBODY® ($V_{HH}$ sequence) of the invention to a carrier, including carriers suitable for pharmaceutical purposes. One non-limiting example are the liposomal formulations described by Cao and Suresh, Journal of Drug Targetting, 8, 4, 257 (2000). Such binding pairs may also be used to link a therapeutically active agent to the NANOBODY® ($V_{HH}$ sequence) of the invention.

For some applications, in particular for those applications in which it is intended to kill a cell that expresses the target against which the NANOBODIES® ($V_{HH}$ sequences) of the invention are directed (e.g. in the treatment of cancer), or to reduce or slow the growth and/or proliferation such a cell, the NANOBODIES® ($V_{HH}$ sequences) of the invention may also be linked to a toxin or to a toxic residue or moiety. Examples of toxic moieties, compounds or residues which can be linked to a NANOBODY® ($V_{HH}$ sequence) of the invention to provide—for example—a cytotoxic compound will be clear to the skilled person and can for example be found in the prior art cited above and/or in the further description herein. One example is the so-called ADEPT™ technology described in WO 03/055527.

Other potential chemical and enzymatical modifications will be clear to the skilled person. Such modifications may also be introduced for research purposes (e.g. to study function-activity relationships). Reference is for example made to Lundblad and Bradshaw, Biotechnol. Appl. Biochem., 26, 143-151 (1997).

Preferably, the derivatives are such that they bind to an envelope protein of a virus with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein for the NANOBODIES® ($V_{HH}$ sequences) of the invention.

As mentioned above, the invention also relates to proteins or polypeptides that essentially consist of or comprise at least one NANOBODY® ($V_{HH}$ sequence) of the invention. By "essentially consist of" is meant that the amino acid sequence of the polypeptide of the invention either is exactly the same as the amino acid sequence of a NANOBODY® ($V_{HH}$ sequence) of the invention or corresponds to the amino acid sequence of a NANOBODY® ($V_{HH}$ sequence) of the invention which has a limited number of amino acid residues, such as 1-20 amino acid residues, for example 1-10 amino acid residues and preferably 1-6 amino acid residues, such as 1, 2, 3, 4, 5 or 6 amino acid residues, added at the amino terminal end, at the carboxy terminal end, or at both the amino terminal end and the carboxy terminal end of the amino acid sequence of the NANOBODY® ($V_{HH}$ sequence). Said amino acid residues may or may not change, alter or otherwise influence the (biological) properties of the NANOBODY® ($V_{HH}$ sequence) and may or may not add further functionality to the NANOBODY® ($V_{HH}$ sequence). For example, such amino acid residues:

- can comprise an N-terminal Met residue, for example as result of expression in a heterologous host cell or host organism.
- may form a signal sequence or leader sequence that directs secretion of the NANOBODY® ($V_{HH}$ sequence) from a host cell upon synthesis. Suitable secretory leader peptides will be clear to the skilled person, and may be as further described herein. Usually, such a leader sequence will be linked to the N-terminus of the NANOBODY® ($V_{HH}$ sequence), although the invention in its broadest sense is not limited thereto;
- may form a sequence or signal that allows the NANOBODY® ($V_{HH}$ sequence) to be directed towards and/or to penetrate or enter into specific organs, tissues, cells, or parts or compartments of cells, and/or that allows the NANOBODY® ($V_{HH}$ sequence) to penetrate or cross a biological barrier such as a cell membrane, a cell layer such as a layer of epithelial cells, a tumor including solid tumors, or the blood-brain-barrier. Examples of such amino acid sequences will be clear to the skilled person and include those mentioned in paragraph c) on page 112 of WO 08/020079.
- may form a "tag", for example an amino acid sequence or residue that allows or facilitates the purification of the NANOBODY® ($V_{HH}$ sequence), for example using affinity techniques directed against said sequence or residue. Thereafter, said sequence or residue may be removed (e.g. by chemical or enzymatical cleavage) to provide the NANOBODY® ($V_{HH}$ sequence) sequence (for this purpose, the tag may optionally be linked to the NANOBODY® ($V_{HH}$ sequence) sequence via a cleavable linker sequence or contain a cleavable motif). Some preferred, but non-limiting examples of such residues are multiple histidine residues, glutathione residues and a myc-tag (see for example SEQ ID NO:31 of WO 06/12282).

may be one or more amino acid residues that have been functionalized and/or that can serve as a site for attachment of functional groups. Suitable amino acid residues and functional groups will be clear to the skilled person and include, but are not limited to, the amino acid residues and functional groups mentioned herein for the derivatives of the NANOBODIES® ($V_{HH}$ sequences) of the invention.

According to another aspect, a polypeptide of the invention comprises a NANOBODY® ($V_{HH}$ sequence) of the invention, which is fused at its amino terminal end, at its carboxy terminal end, or both at its amino terminal end and at its carboxy terminal end to at least one further amino acid sequence, i.e. so as to provide a fusion protein comprising said NANOBODY® ($V_{HH}$ sequence) of the invention and the one or more further amino acid sequences. Such a fusion will also be referred to herein as a "NANOBODY® ($V_{HH}$ sequence) fusion".

The one or more further amino acid sequence may be any suitable and/or desired amino acid sequences. The further amino acid sequences may or may not change, alter or otherwise influence the (biological) properties of the NANOBODY® ($V_{HH}$ sequence), and may or may not add further functionality to the NANOBODY® ($V_{HH}$ sequence) or the polypeptide of the invention. Preferably, the further amino acid sequence is such that it confers one or more desired properties or functionalities to the NANOBODY® ($V_{HH}$ sequence) or the polypeptide of the invention.

For example, the further amino acid sequence may also provide a second binding site, which binding site may be directed against any desired protein, polypeptide, antigen, antigenic determinant or epitope (including but not limited to the same protein, polypeptide, antigen, antigenic determinant or epitope against which the NANOBODY® ($V_{HH}$ sequence) of the invention is directed, or a different protein, polypeptide, antigen, antigenic determinant or epitope).

Example of such amino acid sequences will be clear to the skilled person, and may generally comprise all amino acid sequences that are used in peptide fusions based on conventional antibodies and fragments thereof (including but not limited to ScFv's and single domain antibodies). Reference is for example made to the review by Holliger and Hudson, Nature Biotechnology, 23, 9, 1126-1136 (2005).

For example, such an amino acid sequence may be an amino acid sequence that increases the half-life, the solubility, or the absorption, reduces the immunogenicity or the toxicity, eliminates or attenuates undesirable side effects, and/or confers other advantageous properties to and/or reduces the undesired properties of the polypeptides of the invention, compared to the NANOBODY® ($V_{HH}$ sequence) of the invention per se. Some non-limiting examples of such amino acid sequences are serum proteins, such as human serum albumin (see for example WO 00/27435) or haptenic molecules (for example haptens that are recognized by circulating antibodies, see for example WO 98/22141).

In particular, it has been described in the art that linking fragments of immunoglobulins (such as $V_H$ domains) to serum albumin or to fragments thereof can be used to increase the half-life. Reference is for made to WO 00/27435 and WO 01/077137. According to the invention, the NANOBODY® ($V_{HH}$ sequence) of the invention is preferably either directly linked to serum albumin (or to a suitable fragment thereof) or via a suitable linker, and in particular via a suitable peptide linked so that the polypeptide of the invention can be expressed as a genetic fusion (protein). According to one specific aspect, the NANOBODY® ($V_{HH}$ sequence) of the invention may be linked to a fragment of serum albumin that at least comprises the domain III of serum albumin or part thereof. Reference is for example made to WO 07/112940 of Ablynx N.V.

Alternatively, the further amino acid sequence may provide a second binding site or binding unit that is directed against a serum protein (such as, for example, human serum albumin or another serum protein such as IgG), so as to provide increased half-life in serum. Such amino acid sequences for example include the NANOBODIES® ($V_{HH}$ sequences) described below, as well as the small peptides and binding proteins described in WO 91/01743, WO 01/45746 and WO 02/076489 and the dAb's described in WO 03/002609 and WO 04/003019. Reference is also made to Harmsen et al., Vaccine, 23 (41); 4926-42, 2005, as well as to EP 0 368 684, as well as to WO 08/028977, WO 08/043821, WO 08/043822 and WO 08/068280.

Such amino acid sequences may in particular be directed against serum albumin (and more in particular human serum albumin) and/or against IgG (and more in particular human IgG). For example, such amino acid sequences may be amino acid sequences that are directed against (human) serum albumin and amino acid sequences that can bind to amino acid residues on (human) serum albumin that are not involved in binding of serum albumin to FcRn (see for example WO 06/0122787) and/or amino acid sequences that are capable of binding to amino acid residues on serum albumin that do not form part of domain III of serum albumin (see again for example WO 06/0122787); amino acid sequences that have or can provide an increased half-life (see for example WO 08/028977 by Ablynx N.V.)); amino acid sequences against human serum albumin that are cross-reactive with serum albumin from at least one species of mammal, and in particular with at least one species of primate (such as, without limitation, monkeys from the genus *Macaca* (such as, and in particular, cynomolgus monkeys (*Macaca fascicularis*) and/or rhesus monkeys (*Macaca mulatta*)) and baboon (*Papio ursinus*), reference is again made to WO 08/028977; amino acid sequences that can bind to serum albumin in a pH independent manner (see for example WO2008/043821) and/or amino acid sequences that are conditional binders (see for example WO 08/043822).

According to another aspect, the one or more further amino acid sequences may comprise one or more parts, fragments or domains of conventional 4-chain antibodies (and in particular human antibodies) and/or of heavy chain antibodies. For example, although usually less preferred, a NANOBODY® ($V_{HH}$ sequence) of the invention may be linked to a conventional (preferably human) $V_H$ or $V_L$ domain or to a natural or synthetic analog of a $V_H$ or $V_L$ domain, again optionally via a linker sequence (including but not limited to other (single) domain antibodies, such as the dAb's described by Ward et al.).

The at least one NANOBODY® ($V_{HH}$ sequence) may also be linked to one or more (preferably human) $C_H1$, $C_H2$ and/or $C_H3$ domains, optionally via a linker sequence. For instance, a NANOBODY® ($V_{HH}$ sequence) linked to a suitable $C_H1$ domain could for example be used—together with suitable light chains—to generate antibody fragments/structures analogous to conventional Fab fragments or $F(ab')_2$ fragments, but in which one or (in case of an $F(ab')_2$ fragment) one or both of the conventional $V_H$ domains have been replaced by a NANOBODY® ($V_{HH}$ sequence) of the invention. Also, two NANOBODIES® ($V_{HH}$ sequences) could be linked to a $C_H2$ and/or $C_H3$ domain (optionally via a linker) to provide a construct with increased half-life in vivo.

According to one specific aspect of a polypeptide of the invention, one or more NANOBODIES® ($V_{HH}$ sequences) of the invention may be linked (optionally via a suitable linker or hinge region) to one or more constant domains (for example, 2 or 3 constant domains that can be used as part of/to form an Fc portion), to an Fc portion and/or to one or more antibody parts, fragments or domains that confer one or more effector functions to the polypeptide of the invention and/or may confer the ability to bind to one or more Fc receptors. For example, for this purpose, and without being limited thereto, the one or more further amino acid sequences may comprise one or more $C_H2$ and/or $C_H3$ domains of an antibody, such as from a heavy chain antibody (as described herein) and more preferably from a conventional human 4-chain antibody; and/or may form (part of) and Fc region, for example from IgG (e.g. from IgG1, IgG2, IgG3 or IgG4), from IgE or from another human Ig such as IgA, IgD or IgM. For example, WO 94/04678 describes heavy chain antibodies comprising a Camelid $V_{HH}$ domain or a humanized derivative thereof (i.e. a NANOBODY® ($V_{HH}$ sequence)), in which the Camelidae $C_H2$ and/or $C_H3$ domain have been replaced by human $C_H2$ and $C_H3$ domains, so as to provide an immunoglobulin that consists of 2 heavy chains each comprising a NANOBODY® ($V_{HH}$ sequence) and human $C_H2$ and $C_H3$ domains (but no $C_H1$ domain), which immunoglobulin has the effector function provided by the $C_H2$ and $C_H3$ domains and which immunoglobulin can function without the presence of any light chains. Other amino acid sequences that can be suitably linked to the NANOBODIES® ($V_{HH}$ sequences) of the invention so as to provide an effector function will be clear to the skilled person, and may be chosen on the basis of the desired effector function(s). Reference is for example made to WO 04/058820, WO 99/42077, WO 02/056910 and WO 05/017148, as well as the review by Holliger and Hudson, supra; and to the non-prepublished US provisional application by Ablynx N.V. entitled "Constructs comprising single variable domains and an Fc portion derived from IgE" which has a filing date of Dec. 4, 2007 (see also PCT/EP2008/066366). Coupling of a NANOBODY® ($V_{HH}$ sequence) of the invention to an Fc portion may also lead to an increased half-life, compared to the corresponding NANOBODY® ($V_{HH}$ sequence) of the invention. For some applications, the use of an Fc portion and/or of constant domains (i.e. $C_H2$ and/or $C_H3$ domains) that confer increased half-life without any biologically significant effector function may also be suitable or even preferred. Other suitable constructs comprising one or more NANOBODIES® ($V_{HH}$ sequences) and one or more constant domains with increased half-life in vivo will be clear to the skilled person, and may for example comprise two NANOBODIES® ($V_{HH}$ sequences) linked to a $C_H3$ domain, optionally via a linker sequence. Generally, any fusion protein or derivatives with increased half-life will preferably have a molecular weight of more than 50 kD, the cut-off value for renal absorption.

In another one specific, but non-limiting, aspect, in order to form a polypeptide of the invention, one or more amino acid sequences of the invention may be linked (optionally via a suitable linker or hinge region) to naturally occurring, synthetic or semisynthetic constant domains (or analogs, variants, mutants, parts or fragments thereof) that have a reduced (or essentially no) tendency to self-associate into dimers (i.e. compared to constant domains that naturally occur in conventional 4-chain antibodies). Such monomeric (i.e. not self-associating) Fc chain variants, or fragments thereof, will be clear to the skilled person. For example, Helm et al., J Biol Chem 1996 271 7494, describe monomeric Fc chain variants that can be used in the polypeptide chains of the invention.

Also, such monomeric Fc chain variants are preferably such that they are still capable of binding to the complement or the relevant Fc receptor(s) (depending on the Fc portion from which they are derived), and/or such that they still have some or all of the effector functions of the Fc portion from which they are derived (or at a reduced level still suitable for the intended use). Alternatively, in such a polypeptide chain of the invention, the monomeric Fc chain may be used to confer increased half-life upon the polypeptide chain, in which case the monomeric Fc chain may also have no or essentially no effector functions.

Bivalent/multivalent, bispecific/multispecific or biparatopic/multiparatopic polypeptides of the invention may also be linked to Fc portions, in order to provide polypeptide constructs of the type that is described in the non-prepublished US provisional application U.S. 61/005,331 entitled "immunoglobulin constructs" filed on Dec. 4, 2007 (see also PCT/EP2008/066368).

The further amino acid sequences may also form a signal sequence or leader sequence that directs secretion of the NANOBODY® ($V_{HH}$ sequence) or the polypeptide of the invention from a host cell upon synthesis (for example to provide a pre-, pro- or prepro-form of the polypeptide of the invention, depending on the host cell used to express the polypeptide of the invention).

The further amino acid sequence may also form a sequence or signal that allows the NANOBODY® ($V_{HH}$ sequence) or polypeptide of the invention to be directed towards and/or to penetrate or enter into specific organs, tissues, cells, or parts or compartments of cells, and/or that allows the NANOBODY® ($V_{HH}$ sequence) or polypeptide of the invention to penetrate or cross a biological barrier such as a cell membrane, a cell layer such as a layer of epithelial cells, a tumor including solid tumors, or the blood-brain-barrier. Suitable examples of such amino acid sequences will be clear to the skilled person, and for example include, but are not limited to, those mentioned on page 118 of WO 08/020079. For some applications, in particular for those applications in which it is intended to kill a cell that expresses the target against which the NANOBODIES® ($V_{HH}$ sequences) of the invention are directed (e.g. in the treatment of cancer), or to reduce or slow the growth and/or proliferation of such a cell, the NANOBODIES® ($V_{HH}$ sequences) of the invention may also be linked to a (cyto)toxic protein or polypeptide. Examples of such toxic proteins and polypeptides which can be linked to a NANOBODY® ($V_{HH}$ sequence) of the invention to provide—for example—a cytotoxic polypeptide of the invention will be clear to the skilled person and can for example be found in the prior art cited above and/or in the further description herein. One example is the so-called ADEPT™ technology described in WO 03/055527.

According to one preferred, but non-limiting aspect, said one or more further amino acid sequences comprise at least one further NANOBODY® ($V_{HH}$ sequence), so as to provide a polypeptide of the invention that comprises at least two, such as three, four, five or more NANOBODIES® ($V_{HH}$ sequences), in which said NANOBODIES® ($V_{HH}$ sequences) may optionally be linked via one or more linker sequences (as defined herein). As described on pages 119 and 120 of WO 08/020079, polypeptides of the invention that comprise two or more NANOBODIES® ($V_{HH}$ sequences), of which at least one is a NANOBODY® ($V_{HH}$ sequence) of the invention, will also be referred to herein as "multivalent" polypeptides of the invention, and the NANOBODIES® ($V_{HH}$ sequences) present in such polypeptides will also be referred to herein as being in a "multivalent format". For example, "bivalent" and "trivalent" polypeptides of the invention may be as further described on pages 119 and 120 of WO 08/020079.

Polypeptides of the invention that contain at least two NANOBODIES® ($V_{HH}$ sequences), in which at least one NANOBODY® ($V_{HH}$ sequence) is directed against a first antigen (i.e. against an envelope protein of a virus) and at least one NANOBODY® ($V_{HH}$ sequence) is directed against a second antigen (i.e. different from an envelope protein of a virus), will also be referred to as "multispecific" polypeptides of the invention, and the NANOBODIES® ($V_{HH}$ sequences) present in such polypeptides will also be referred to herein as being in a "multispecific format". Thus, for example, a "bispecific" polypeptide of the invention is a polypeptide that comprises at least one NANOBODY® ($V_{HH}$ sequence) directed against a first antigen (i.e. an envelope protein of a virus) and at least one further NANOBODY® ($V_{HH}$ sequence) directed against a second antigen (i.e. different from the envelope protein of a virus), whereas a "trispecific" polypeptide of the invention is a polypeptide that comprises at least one NANOBODY® ($V_{HH}$ sequence) directed against a first antigen (i.e. an envelope protein of a virus), at least one further NANOBODY® ($V_{HH}$ sequence) directed against a second antigen (i.e. different from said envelope protein of a virus) and at least one further NANOBODY® ($V_{HH}$ sequence) directed against a third antigen (i.e. different from both said envelope protein of a virus and the second antigen); etc.

Accordingly, in its simplest form, a bispecific polypeptide of the invention is a bivalent polypeptide of the invention (as defined herein), comprising a first NANOBODY® ($V_{HH}$ sequence) directed against an envelope protein of a virus and a second NANOBODY® ($V_{HH}$ sequence) directed against a second antigen, in which said first and second NANOBODY® ($V_{HH}$ sequence) may optionally be linked via a linker sequence (as defined herein); whereas a trispecific polypeptide of the invention in its simplest form is a trivalent polypeptide of the invention (as defined herein), comprising a first NANOBODY® ($V_{HH}$ sequence) directed against an envelope protein of a virus, a second NANOBODY® ($V_{HH}$ sequence) directed against a second antigen and a third NANOBODY® ($V_{HH}$ sequence) directed against a third antigen, in which said first, second and third NANOBODY® ($V_{HH}$ sequence) may optionally be linked via one or more, and in particular one and more, in particular two, linker sequences.

However, as will be clear from the description hereinabove, the invention is not limited thereto, in the sense that a multispecific polypeptide of the invention may comprise at least one NANOBODY® ($V_{HH}$ sequence) against an envelope protein of a virus, and any number of NANOBODIES® ($V_{HH}$ sequences) directed against one or more antigens different from said envelope protein of a virus.

Furthermore, although it is encompassed within the scope of the invention that the specific order or arrangement of the various NANOBODIES® ($V_{HH}$ sequences) in the polypeptides of the invention may have some influence on the properties of the final polypeptide of the invention (including but not limited to the affinity, specificity or avidity for the envelope protein of a virus, or against the one or more other antigens), said order or arrangement is usually not critical and may be suitably chosen by the skilled person, optionally after some limited routine experiments based on the disclosure herein. Thus, when reference is made to a specific multivalent or multispecific polypeptide of the invention, it should be noted that this encompasses any order or arrangements of the relevant NANOBODIES® ($V_{HH}$ sequences), unless explicitly indicated otherwise.

Finally, it is also within the scope of the invention that the polypeptides of the invention contain two or more NANOBODIES® ($V_{HH}$ sequences) and one or more further amino acid sequences (as mentioned herein).

As further described herein, a polypeptide of the invention may contain two or more amino acid sequences and/or NANOBODIES® ($V_{HH}$ sequences) of the invention that are directed against an envelope protein of a virus. Generally, such polypeptides will bind to an envelope protein of a virus with increased avidity compared to a single amino acid sequence or NANOBODY® ($V_{HH}$ sequence) of the invention. Such a polypeptide may for example comprise two amino acid sequences and/or NANOBODIES® ($V_{HH}$ sequences) of the invention that are directed against the same antigenic determinant, epitope, part, domain, subunit or conformation (where applicable) of an envelope protein of a virus (which may or may not be an interaction site); or comprise at least one "first" amino acid sequence of the invention that is directed against a first same antigenic determinant, epitope, part, domain, subunit or conformation (where applicable) of an envelope protein of a virus (which may or may not be an interaction site); and at least one "second" amino acid sequence and/or NANOBODY® ($V_{HH}$ sequence) of the invention that is directed against a second antigenic determinant, epitope, part, domain, subunit or conformation (where applicable) different from the first (and which again may or may not be an interaction site). Preferably, in such "biparatopic" polypeptides of the invention, at least one amino acid sequence and/or NANOBODY® ($V_{HH}$ sequence) of the invention is directed against an interaction site (as defined herein), although the invention in its broadest sense is not limited thereto.

It is thus also within the scope of the invention that, where applicable, a polypeptide of the invention can bind to two or more antigenic determinants, epitopes, parts, domains, subunits or conformations of an envelope protein of a virus. In such a case, the antigenic determinants, epitopes, parts, domains or subunits of said envelope protein of a virus to which the amino acid sequences and/or polypeptides of the invention bind may be essentially the same (for example, if an envelope protein of a virus contains repeated structural motifs or occurs in a multimeric form) or may be different (and in the latter case, the amino acid sequences and polypeptides of the invention are said to be "bi- and/or multiparatopic" and may bind to such different antigenic determinants, epitopes, parts, domains, subunits of said envelope protein of a virus with an affinity and/or specificity which may be the same or different) . Accordingly, bi- or multiparatopic polypeptides of the present invention are directed against and/or specifically bind to at least two epitopes of an envelope protein of a virus, and are for example (but not limited to) polypeptides that are directed against and/or can specifically bind to three or even more epitopes of the same envelope protein of a virus.

Also, the polypeptides of the present invention may be directed against and/or can specifically bind to at least one particular envelope protein of a virus and at least one further epitope of another target, which is different from said at least one particular envelope protein. For example (but not limited to), the polypeptides of the present invention may be directed against and/or can specifically bind to at least one particular envelope protein of a virus and at least one further epitope of a virus, for instance at least one further epitope of a viral protein, such as at least one further epitope of another particular viral envelope protein. Thus, the polypeptides according to the invention may be directed against and/or may specifically bind to at least two (or even more) epitopes of at least two different envelope proteins. Also, said at least one further epitope of a virus may or may not be involved in one or more of the viral-mediated biological pathways, in which an envelope protein of a virus and/or its viral receptor is involved; more specifically said at least one further epitope of a virus may or may not be involved in viral entry in a target host cell, such as virion attachment to a target host cell and/or viral fusion with a target host cell or said at least one further epitope of a virus may or may not be involved in viral replication in a target host cell, such as viral transcription and/or viral translation and/or viral packaging and/or the formation of functional virions and/or budding of nascent virions from the target host cell membrane.

Generally, bi-, tri- and multivalent (as defined herein), bi-, tri- and multispecific (as defined herein) and bi-, tri- and multiparatopic (as defined herein) polypeptides according to the invention may be useful for the prevention and/or treatment of viral diseases by specifically binding to at least one epitope of an envelope protein of a virus and at least one further epitope (which may or may not be different from said at least one epitope) of a target, wherein said target may or may not be different from said envelope protein.

Preferably, bi-, tri- and multivalent (as defined herein) and bi-, tri- and multiparatopic polypeptides (as defined herein) according to the invention may be useful for the prevention and/or treatment of viral diseases by specifically binding to at least two (or even more) epitopes (which may be the same or different) on the same envelope protein of a virus.

Alternatively, the polypeptides of the present invention may be directed against and/or can specifically bind to at least one epitope of an envelope protein of a virus and at least one further epitope of another target, which is different from said particular envelope protein and which is for instance a further epitope of a virus, such as a further epitope of a viral protein or a further epitope of another particular viral envelope protein.

Preferably, such bi-, tri- and multivalent, bi-, tri- and multispecific, and bi-, tri- and multiparatopic polypeptides, as discussed hereabove, will bind to (an envelope protein of) a virus with increased avidity compared to a single amino acid sequence and/or NANOBODY® ($V_{HH}$ sequence) of the invention.

More specifically, bi-, tri- and multivalent, bi-, tri- and multiparatopic and bi-, tri- and multispecific polypeptides according to the invention may be useful in targeting multiple viral receptor binding sites on the same and on different envelope proteins, respectively, which can result in an increased potency of viral neutralization (as defined herein) compared to a single amino acid sequence of the invention. Also, bi-, tri- and multivalent and bi-, tri- and multiparatopic polypeptides according to the invention (i.e. that are directed against and/or specifically bind to at least two epitopes of the same envelope protein) may be useful in preventing viral escape and/or viral evasion.

Also, bi-, tri-, and multivalent, bi-, tri-, and multispecific and/or bi-, tri-, and multiparatopic polypeptides according to the invention may be useful in binding different genotypes, different subtypes and/or different strains and/or clades of a certain virus. Also, bi-, tri-, and multivalent, bi-, tri-, and multispecific and/or bi-, tri-, and multiparatopic polypeptides according to the invention may be useful in preventing viral escape and/or viral evasion.

In a specific aspect of the invention, the bi-, tri-, and multivalent, bi-, tri-, and multispecific and/or bi-, tri-, and multiparatopic polypeptides according to the invention may be directed against influenza virus and may bind influenza subtype H5N1 as well as influenza subtype H1N1. In another aspect, the bi-, tri-, and multivalent, bi-, tri-, and multispecific and/or bi-, tri-, and multiparatopic polypeptides according to the invention may bind influenza subtype H5N1 as well as influenza subtype H3N2. In another aspect, the bi-, tri-, and multivalent, bi-, tri-, and multispecific and/or bi-, tri-, and multiparatopic polypeptides according to the invention may bind influenza subtype H1N1 as well as influenza subtype H3N2. In another aspect, the bi-, tri-, and multivalent, bi-, tri-, and multispecific and/or bi-, tri-, and multiparatopic polypeptides according to the invention may bind influenza subtype H5N1 as well as influenza subtype H2N2. In another aspect, the bi-, tri-, and multivalent, bi-, tri-, and multispecific and/or bi-, tri-, and multiparatopic polypeptides according to the invention may bind influenza subtype H5N1, influenza subtype H1N1 as well as influenza subtype H2N2. Yet in another aspect, the bi-, tri-, and multivalent, bi-, tri-, and multispecific and/or bi-, tri-, and multiparatopic polypeptides according to the invention may be directed against influenza virus and may bind influenza subtype H5N1, influenza subtype H1N1 as well as influenza subtype H3N2. Yet in another aspect, the bi-, tri-, and multivalent, bi-, tri-, and multispecific and/or bi-, tri-, and multiparatopic polypeptides according to the invention may be directed against influenza virus and may bind influenza subtype H5N1, influenza subtype H2N2 as well as influenza subtype H3N2. Yet in another aspect, the bi-, tri-, and multivalent, bi-, tri-, and multispecific and/or bi-, tri-, and multiparatopic polypeptides according to the invention may be directed against influenza virus and may bind influenza subtype H5N1, influenza subtype H1N1, influenza subtype H2N2, as well as influenza subtype H3N2.

In another aspect, the bi-, tri-, and multivalent, bi-, tri-, and multispecific and/or bi-, tri-, and multiparatopic polypeptides according to the invention are directed against the G envelope protein of rabies and may bind rabies genotype 1 as well as genotype 5.

In yet another aspect, the bi-, tri-, and multivalent, bi-, tri-, and multispecific and/or bi-, tri-, and multiparatopic polypeptides according to the invention may be directed against RSV and may bind different escape mutants of RSV (such as e.g. described in Lopez et al. 1998, J. Virol. 72: 6922-6928) and/or one or more escape mutants specific for antigen site II, specific for antigen site IV-VI and/or specific for the combination of both antigenic sites.

In this respect it was observed in the present invention that bi-, tri-, and multivalent, bi-, tri-, and multispecific and/or bi-, tri-, and multiparatopic polypeptides according to the invention show improved binding and/or in vitro and/or in vivo neutralization of different genotypes, different subtypes and/or different strains and/or clades of a certain virus. Also, the bi-, tri-, and multivalent, bi-, tri-, and multispecific and/or bi-, tri-, and multiparatopic polypeptides according to the invention showed improved binding and/or neutralization of viral escape mutants.

In one specific aspect, the bi-, tri-, and multivalent, bi-, tri-, and multispecific and/or bi-, tri-, and multiparatopic polypeptides according to the invention showed improved binding and/or neutralization of certain subtypes of influenza (such as H1, H2, H3 and H5). The bi-, tri-, and multivalent, bi-, tri-, and multispecific and/or bi-, tri-, and multiparatopic polypeptides according to the invention showed improved binding and/or neutralization of different clades of influenza virus. The bi-, tri-, and multivalent, bi-, tri-, and multispecific and/or bi-, tri-, and multiparatopic polypeptides according to the invention showed improved competition with sialic acid for binding hemaglutinin H5 of influenza virus.

In another aspect, the bi-, tri-, and multivalent, bi-, tri-, and multispecific and/or bi-, tri-, and multiparatopic polypeptides according to the invention showed improved binding and/or neutralization of different strains of rabies. The bi-, tri-, and multivalent, bi-, tri-, and multispecific and/or bi-, tri-, and multiparatopic polypeptides according to the invention also showed improved binding and/or neutralization of different genotypes of rabies (such as genotype 1 and genotype 5).

In yet another aspect, the bi-, tri-, and multivalent, bi-, tri-, and multispecific and/or bi-, tri-, and multiparatopic polypeptides according to the invention showed improved binding and/or neutralization of different strains of RSV (such as Long, A-2 and B-1). The bi-, tri-, and multivalent, bi-, tri-, and multispecific and/or bi-, tri-, and multiparatopic polypeptides according to the invention showed improved binding and/or neutralization of different escape mutants of RSV (such as e.g. the escape mutants described in Lopez et al. 1998, J. Virol. 72: 6922-6928, one or more escape mutants specific for antigen site II, escape mutants specific for antigen site IV-VI, escape mutants specific for the combination of both antigenic sites).

Finally, bi-, tri- and multivalent, bi-, tri- and multispecific and bi-, tri- and multiparatopic polypeptides according to the invention may be useful in preventing and/or inhibiting viral infection and/or viral fusion of a virion with its target host cell (as defined herein) or may be useful in neutralizing a virus by inducing virion aggregation of said virus.

For multivalent and multispecific polypeptides containing one or more $V_{HH}$ domains and their preparation, reference is also made to Conrath et al., J. Biol. Chem., Vol. 276, 10. 7346-7350, 2001; Muyldermans, Reviews in Molecular Biotechnology 74 (2001), 277-302; as well as to for example WO 96/34103 and WO 99/23221. Some other examples of some specific multispecific and/or multivalent polypeptide of the invention can be found in the applications by Ablynx N.V. referred to herein.

In one aspect, the NANOBODIES® ($V_{HH}$ sequences) of the invention may be attached to non-NANOBODY® ($V_{HH}$ sequence) polypeptides. The non-NANOBODY® ($V_{HH}$ sequence) polypeptides may be polypeptides that provide the NANOBODIES® ($V_{HH}$ sequences) with an additional functionality. For example, the non-NANOBODY® ($V_{HH}$ sequence) polypeptides may provide the NANOBODIES® ($V_{HH}$ sequences) of the invention with increased stability and/or in vivo half-life. In some embodiments, the non-NANOBODY® ($V_{HH}$ sequence) polypeptide may be a non-antigen binding fragment of an antibody. In some embodiments, the non-NANOBODY® ($V_{HH}$ sequence) polypeptide may be a Fc fragment of human IgG1. In some embodiments, the non-NANOBODY® ($V_{HH}$ sequence) polypeptide may also comprises the hinge regions of the Fc fragment. In some embodiments, the non-NANOBODY® ($V_{HH}$ sequence) polypeptide may be coupled to the NANOBODY® ($V_{HH}$ sequence) by one or more linkers. In some embodiments, the non-NANOBODY® ($V_{HH}$ sequence) polypeptide may be coupled to multiple NANOBODIES® ($V_{HH}$ sequences). In some embodiments, the multiple NANOBODIES® ($V_{HH}$ sequences) are coupled at each side of the non-NANOBODY® ($V_{HH}$ sequence) polypeptide (see FIG. 59). In some embodiments, the multiple NANOBODIES® ($V_{HH}$ sequences) are coupled at one side of the non-NANOBODY® ($V_{HH}$ sequence) polypeptide (see FIG. 60). In some embodiments, the non-NANOBODY® ($V_{HH}$ sequence) polypeptide is coupled to a bi-, tri- or multivalent, bi-, tri-, or multiparatopic or bi-, tri-, or multispecific polypeptide as described above. In some embodiments, the non-NANOBODY® ($V_{HH}$ sequence) polypeptide is coupled, at one side of the non-NANOBODY® ($V_{HH}$ sequence) polypeptide, to a bi-, tri- or multivalent, bi-, tri-, or multiparatopic or bi-, tri-, or multispecific polypeptide as described above (FIGS. 60 and 61). In some embodiments, the non-NANOBODY® ($V_{HH}$ sequence) polypeptide is coupled, at both sides of the non-NANOBODY® ($V_{HH}$ sequence) polypeptide, to a bi-, tri- or multivalent, bi-, tri-, or multiparatopic or bi-, tri-, or multispecific polypeptide as described above (FIG. 62). In some embodiments, the non-NANOBODY® ($V_{HH}$ sequence) polypeptide is coupled, at one side of the non-NANOBODY® ($V_{HH}$ sequence) polypeptide, to a NANOBODY® ($V_{HH}$ sequence) as described above and, at one side of the non-NANOBODY® ($V_{HH}$ sequence) polypeptide, to a bi-, tri- or multivalent, bi-, tri-, or multiparatopic or bi-, tri-, or multispecific polypeptide as described above (FIG. 63). In some embodiments, the multiple NANOBODIES® ($V_{HH}$ sequences) are directed against the same antigen. In some embodiments, the multiple NANOBODIES® ($V_{HH}$ sequences) are directed against a different epitope on the same antigen. In some embodiments, the multiple NANOBODIES® ($V_{HH}$ sequences) are directed against the same epitope on the same antigen. In some embodiments, the multiple NANOBODIES® ($V_{HH}$ sequences) are identical. Non-limiting examples of NANOBODY® ($V_{HH}$ sequence) constructs comprising IgG1 Fc fragments are provided in FIG. 46, Table A-5 and Example 53. Preferred NANOBODIES® ($V_{HH}$ sequences) of the invention that comprise an Fc fragment are SEQ ID NO's: 2641 to 2659 and 2978 to 2988 (Table A-5).

In this respect, the present invention in general also relates to NANOBODY® ($V_{HH}$ sequence) constructs (also referred to as "polypeptide chain construct of the invention") that comprise two polypeptide chains (each, a "polypeptide chain of the invention"), in which each polypeptide chain comprises two or more single variable domains that are linked, usually via a suitable hinge region or linker, to one or more constant domains that, in the final construct, together form an Fc portion. The single variable domains may be linked at one side of the constant domain or the single variable domains may be linked at both sides of the constant domain.

Thus, the polypeptide chain construct provided by the invention generally comprises an Fc portion (as defined herein) in which each of the two polypeptide chains that form the Fc portion is linked, optionally via a suitable linker or hinge region, to two or more single variable domains (also as defined herein). More specifically, in one aspect, one variable domain may be linked at each side of the Fc portion. In another aspect, two variable domains may be linked at one side of the Fc portion. In another aspect, three variable domains may be linked at one side of the Fc portion. In another aspect, two variable domains may be linked at each side of the Fc portion. In another aspect, three variable domains may be linked at each side of the Fc portion. In another aspect, two variable domains may be linked at one side of the Fc portion and one variable domain may be linked at the other side of the Fc portion.

The polypeptide chains of the invention, and their use in forming the polypeptide chain construct s of the invention, form further aspects of the invention. Also, in one specific aspect of the invention, as further described herein, these polypeptide chains of the invention may also be used as such (i.e. without interaction with another polypeptide chain and/or not as part of a construct of the invention).

Preferably, in the polypeptide chain constructs of the invention, each polypeptide chain of the invention comprises two, three or four single variable domains, and more preferably only two or three single variable domains, and even more preferably only two single variable domains. In other words, the polypeptide chain constructs of the invention preferably comprise a total of four (i.e. two in each polypeptide chain), six (i.e. three in each polypeptide chain) or eight (i.e. four in each polypeptide chain) single variable domains and more preferably a total of four single variable domains (i.e. two in each polypeptide chain) or six (i.e. three in each polypeptide chain), and even more preferably a total of four single variable domains (i.e. two in each polypeptide chain).

Also, each polypeptide chain of the invention will usually comprise either two constant domains (for example, in case of an Fc portion that is derived from IgG, IgA or IgD) or three constant domains (for example, in case of an Fc portion that is derived from IgM or IgE), such that, in the final construct, the constant domains of the two polypeptide chains form an Fc portion, for example an Fc portion that is derived from IgG (e.g. IgG1, IgG2, IgG3 or IgG4), IgA, IgD, IgE or IgM, or a variant, analog, mutant, part or fragment thereof (including chimeric Fc portions), that may or may not have effector functions, as further described herein.

For the sake of convenience, and as these polypeptide chain constructs are generally preferred in practice, the invention will now be described in more detail with reference to polypeptide chain constructs that comprise four constant domains (i.e. two in each polypeptide chain), in which the variable domains are linked to each other via a suitable linker and are linked to the constant domains via a suitable linker or hinge region. However, it will be clear to the skilled person that the teaching of the present invention can equally be applied to polypeptide chain constructs of the invention that comprise six constant domains (for example, in case of an Fc portion that is derived from IgM or IgE), and/or in which the constant domains are directly linked to each other and/or directly linked to the variable domains (for example, when the Fc portion is derived from IgE, a hinge region between the Fc portion and the variable domains may not be required).

Polypeptide chain construct of the invention with four single variable domains and four constant domains (for example forming an Fc portion derived from an IgG or IgA, or an analog, mutant or variant thereof) are schematically shown in the non-limiting FIGS. 59 and 60.

In FIG. 59, the polyp eptide chain constructs comprise two polyp eptide chains (1) and (2), which each comprise two constant domains (3) and (4), a “first” single variable domain (5) and a “second” single variable domain (6). The first single variable domain (5) is linked, optionally via a suitable linker or hinge region (7) to the constant domain (3). The second single variable domain (6) is linked, optionally via a suitable linker or hinge region (8) to the constant domain (4). The constant domains (3) and (4) of the polypeptide chain (1) and the corresponding constant domains (3) and (4) of the polypeptide chain (2) together form the Fc portion (9).

In FIG. 60, the polypeptide chain constructs comprise two polypeptide chains (1) and (2), which each comprise two constant domains (3) and (4), a “first” single variable domain (5) and a “second” single variable domain (6). The first single variable domain (5) is linked, optionally via a suitable linker (7), to the second single variable domain (6), and is also linked to the constant domains, optionally (and usually) via a suitable linker or hinge region (8). The constant domains (3) and (4) of the polypeptide chain (1) and the corresponding constant domains (3) and (4) of the polypeptide chain (2) together form the Fc portion (9).

An example of a polypeptide chain construct of the invention with more than four single variable domains is schematically shown in the non-limiting FIGS. 61, 62 and 63.

FIG. 61 shows a polypeptide chain construct of the invention with six single variable domains and four constant domains (for example forming an Fc portion derived from an IgG or IgA, or an analog, mutant or variant thereof). The construct comprise two polypeptide chains (1) and (2), which each comprise two constant domains (3) and (4), a “first” single variable domain (5), a “second” single variable domain (6) and a “third” single variable domain (10). The first single variable domain (5) is linked, optionally via a suitable linker (7), to the second single variable domain (6), and is also linked to the constant domains, optionally (and usually) via a suitable linker or hinge region (8). The third single variable domain (11) is linked, optionally via a suitable linker (12), to the second single variable domain (6). The constant domains (3) and (4) of the polypeptide chain (1) and the corresponding constant domains (3) and (4) of the polypeptide chain (2) together form the Fc portion (9).

FIG. 62 shows a polypeptide chain construct of the invention with eight single variable domains and four constant domains (for example forming an Fc portion derived from an IgG or IgA, or an analog, mutant or variant thereof). The construct comprise two polypeptide chains (1) and (2), which each comprise two constant domains (3) and (4), a “first” single variable domain (5), a “second” single variable domain (6), a “third” single variable domain (10) and a “fourth” single variable domain (13). The first single variable domain (5) is linked, optionally via a suitable linker (7), to the second single variable domain (6), and is also linked to the constant domain (3), optionally (and usually) via a suitable linker or hinge region (8). The third single variable domain (10) is linked, optionally via a suitable linker (12), to the fourth single variable domain (13), and is also linked to the constant domain (4), optionally (and usually) via a suitable linker or hinge region (14). The constant domains (3) and (4) of the polypeptide chain (1) and the corresponding constant domains (3) and (4) of the polypeptide chain (2) together form the Fc portion (9).

FIG. 63 shows a polypeptide chain construct of the invention with six single variable domains and four constant domains (for example forming an Fc portion derived from an IgG or IgA, or an analog, mutant or variant thereof). The construct comprise two polypeptide chains (1) and (2), which each comprise two constant domains (3) and (4), a “first” single variable domain (5), a “second” single variable domain (6) and a “third” single variable domain (10). The first single variable domain (5) is linked, optionally via a suitable linker (7), to the second single variable domain (6), and is also linked to the constant domain (3), optionally (and usually) via a suitable linker or hinge region (8). The third single variable domain (10) is linked to the constant domain (4), optionally (and usually) via a suitable linker or hinge region (14). The constant domains (3) and (4) of the polypeptide chain (1) and the corresponding constant domains (3) and (4) of the polypeptide chain (2) together form the Fc portion (9).

In polypeptide chain constructs with more than six or eight single variable domains, each chain (1) and (2) can contain one or more additional single variable domains (not shown), which can be linked to the present single variable domain, again optionally via suitable linkers.

In the polypeptide chain constructs of the invention, all of the single variable domains that are present in the construct may each be directed against a different target, antigen, antigenic determinant or epitope. However, this is generally less preferred. Preferably, both of the “first” single variable domains that are present in each of the polypeptide chain are directed against the same target or antigen, and both of the “second” single variable domains that are present in each of the polypeptide chain are directed against the same target or antigen (and so on for the "third", "fourth" and further single variable domains).

In this aspect of the invention, the first single variable domains and second single variable domains (and so on for the "third", "fourth" and further single variable domains) may be directed against a different target or antigen (such that the constructs of the invention are capable of simultaneously binding to two or more different targets or antigens); or may be directed against the same target or antigen (such that all single variable domains present in the construct are capable of binding to the same target or antigen).

As further described herein, when two or more single variable domains in a polypeptide chain construct of the invention are capable of binding to the same target or antigen, they may bind to the same epitope, antigenic determinant, part, domain or subunit of the target or antigen, or to different epitopes, antigenic determinants, parts, domains or subunits of the target or antigen.

One preferred, but non-limiting example of a multispecific polypeptide of the invention comprises at least one NANOBODY® ($V_{HH}$ sequence) of the invention and at least one NANOBODY® ($V_{HH}$ sequence) that provides for an increased half-life. Such NANOBODIES® ($V_{HH}$ sequences) may for example be NANOBODIES® ($V_{HH}$ sequences) that are directed against a serum protein, and in particular a human serum protein, such as human serum albumin, thyroxine-binding protein, (human) transferrin, fibrinogen, an immunoglobulin such as IgG, IgE or IgM, or against one of the serum proteins listed in WO 04/003019. Of these, NANOBODIES® ($V_{HH}$ sequences) that can bind to serum albumin (and in particular human serum albumin) or to IgG (and in particular human IgG, see for example NANOBODY® ($V_{HH}$ sequence) VH-1 described in the review by Muyldermans, supra) are particularly preferred (although for example, for experiments in mice or primates, NANOBODIES® ($V_{HH}$ sequences) against or cross-reactive with mouse serum albumin (MSA) or serum albumin from said primate, respectively, can be used. However, for pharmaceutical use, NANOBODIES® ($V_{HH}$ sequences) against human serum albumin or human IgG will usually be preferred). NANOBODIES® ($V_{HH}$ sequences) that provide for increased half-life and that can be used in the polypeptides of the invention include the NANOBODIES® ($V_{HH}$ sequences) directed against serum albumin that are described in WO 04/041865, in WO 06/122787 and in the further patent applications by Ablynx N.V., such as those mentioned above.

For example, some preferred NANOBODIES® ($V_{HH}$ sequences) that provide for increased half-life for use in the present invention include NANOBODIES® ($V_{HH}$ sequences) that can bind to amino acid residues on (human) serum albumin that are not involved in binding of serum albumin to FcRn (see for example WO 06/0122787); NANOBODIES® ($V_{HH}$ sequences) that are capable of binding to amino acid residues on serum albumin that do not form part of domain III of serum albumin (see for example WO 06/0122787); NANOBODIES® ($V_{HH}$ sequences) that have or can provide an increased half-life (see for example WO 2008/028977); NANOBODIES® ($V_{HH}$ sequences) against human serum albumin that are cross-reactive with serum albumin from at least one species of mammal, and in particular with at least one species of primate (such as, without limitation, monkeys from the genus *Macaca* (such as, and in particular, cynomolgus monkeys (*Macaca fascicularis*) and/or rhesus monkeys (*Macaca mulatta*)) and baboon (*Papio ursinus*)) (see for example WO 2008/028977)); NANOBODIES® ($V_{HH}$ sequences) that can bind to serum albumin in a pH independent manner (see for example WO 08/043821) and/or NANOBODIES® ($V_{HH}$ sequences) that are conditional binders (see for example WO 08/043822).

Some particularly preferred NANOBODIES® ($V_{HH}$ sequences) that provide for increased half-life and that can be used in the polypeptides of the invention include the NANOBODIES® ($V_{HH}$ sequences) ALB-1 to ALB-10 disclosed in WO 06/122787 (see Tables II and III) of which ALB-8 (SEQ ID NO: 62 in WO 06/122787) is particularly preferred.

According to a specific, but non-limiting aspect of the invention, the polypeptides of the invention contain, besides the one or more NANOBODIES® ($V_{HH}$ sequences) of the invention, at least one NANOBODY® ($V_{HH}$ sequence) against human serum albumin.

Generally, any polypeptides of the invention with increased half-life that contain one or more NANOBODIES® ($V_{HH}$ sequences) of the invention, and any derivatives of NANOBODIES® ($V_{HH}$ sequences) of the invention or of such polypeptides that have an increased half-life, preferably have a half-life that is at least 1.5 times, preferably at least 2 times, such as at least 5 times, for example at least 10 times or more than 20 times, greater than the half-life of the corresponding NANOBODY® ($V_{HH}$ sequence) of the invention per se. For example, such a derivative or polypeptides with increased half-life may have a half-life that is increased with more than 1 hours, preferably more than 2 hours, more preferably more than 6 hours, such as more than 12 hours, or even more than 24, 48 or 72 hours, compared to the corresponding NANOBODY® ($V_{HH}$ sequence) of the invention per se.

In a preferred, but non-limiting aspect of the invention, such derivatives or polypeptides may exhibit a serum half-life in human of at least about 12 hours, preferably at least 24 hours, more preferably at least 48 hours, even more preferably at least 72 hours or more. For example, such derivatives or polypeptides may have a half-life of at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).

According to one aspect of the invention the polypeptides are capable of binding to one or more molecules which can increase the half-life of the polypeptide in vivo.

The polypeptides of the invention are stabilised in vivo and their half-life increased by binding to molecules which resist degradation and/or clearance or sequestration. Typically, such molecules are naturally occurring proteins which themselves have a long half-life in vivo.

Another preferred, but non-limiting example of a multispecific polypeptide of the invention comprises at least one NANOBODY® ($V_{HH}$ sequence) of the invention and at least one NANOBODY® ($V_{HH}$ sequence) that directs the polypeptide of the invention towards, and/or that allows the polypeptide of the invention to penetrate or to enter into specific organs, tissues, cells, or parts or compartments of cells, and/or that allows the NANOBODY® ($V_{HH}$ sequence) to penetrate or cross a biological barrier such as a cell membrane, a cell layer such as a layer of epithelial cells, a tumor including solid tumors, or the blood-brain-barrier. Examples of such NANOBODIES® ($V_{HH}$ sequences) include NANOBODIES® ($V_{HH}$ sequences) that are directed towards specific cell-surface proteins, markers or epitopes of the desired organ, tissue or cell (for example cell-surface markers associated with tumor cells), and the single-domain brain targeting antibody fragments described in WO 02/057445 and WO 06/040153, of which FC44 (SEQ ID NO: 189 of WO 06/040153) and FC5 (SEQ ID NO: 190 of WO 06/040154) are preferred examples.

In the polypeptides of the invention, the one or more NANOBODIES® ($V_{HH}$ sequences) and the one or more polypeptides may be directly linked to each other (as for example described in WO 99/23221) and/or may be linked to each other via one or more suitable spacers or linkers, or any combination thereof.

Suitable spacers or linkers for use in multivalent, multiparatopic and multispecific polypeptides and polypeptide chains will be clear to the skilled person, and may generally be any linker or spacer used in the art to link amino acid sequences. Preferably, said linker or spacer is suitable for use in constructing proteins or polypeptides that are intended for pharmaceutical use.

Some particularly preferred spacers include the spacers and linkers that are used in the art to link antibody fragments or antibody domains. These include the linkers mentioned in the general background art cited above, as well as for example linkers that are used in the art to construct diabodies or ScFv fragments (in this respect, however, its should be noted that, whereas in diabodies and in ScFv fragments, the linker sequence used should have a length, a degree of flexibility and other properties that allow the pertinent $V_H$ and $V_L$ domains to come together to form the complete antigen-binding site, there is no particular limitation on the length or the flexibility of the linker used in the polypeptide of the invention, since each NANOBODY® ($V_{HH}$ sequence) by itself forms a complete antigen-binding site).

For example, a linker may be a suitable amino acid sequence, and in particular amino acid sequences of between 1 and 50, preferably between 1 and 30, such as between 1 and 10 amino acid residues. Some preferred examples of such amino acid sequences include gly-ser linkers, for example of the type $(gly_x ser_y)_z$, such as (for example $(gly_4 ser)_3$ or $(gly_3 ser_2)_3$, as described in WO 99/42077 and the GS30, GS15, GS9 and GS7 linkers described in the applications by Ablynx mentioned herein (see for example WO 06/040153 and WO 06/122825), as well as hinge-like regions, such as the hinge regions of naturally occurring heavy chain antibodies or similar sequences (such as described in WO 94/04678).

Some other particularly preferred linkers are poly-alanine (such as AAA), as well as the linkers GS30 (SEQ ID NO: 85 in WO 06/122825) and GS9 (SEQ ID NO: 84 in WO 06/122825). Other preferred linkers may comprise or consist of a hinge region, a ($Gly_x$-$Ser_y$) repeat or a combination of ($Gly_x$-$Ser_y$) with a hinge region (such as e.g. used in the construes of Table A-5 and/or depicted in Table A-7).

Other suitable linkers generally comprise organic compounds or polymers, in particular those suitable for use in proteins for pharmaceutical use. For instance, poly(ethyleneglycol) moieties have been used to link antibody domains, see for example WO 04/081026.

It is encompassed within the scope of the invention that the length, the degree of flexibility and/or other properties of the linker(s) used (although not critical, as it usually is for linkers used in ScFv fragments) may have some influence on the properties of the final polypeptide of the invention, including but not limited to the affinity, specificity or avidity for the envelope protein, or for one or more of the other antigens. Based on the disclosure herein, the skilled person will be able to determine the optimal linker(s) for use in a specific polypeptide of the invention, optionally after some limited routine experiments.

For example, in multivalent polypeptides of the invention that comprise NANOBODIES® ($V_{HH}$ sequences) directed against a multimeric antigen (such as a multimeric receptor or other protein), the length and flexibility of the linker are preferably such that it allows each NANOBODY® ($V_{HH}$ sequence) of the invention present in the polypeptide to bind to the antigenic determinant on each of the subunits of the multimer. Similarly, in a multispecific polypeptide of the invention that comprises NANOBODIES® ($V_{HH}$ sequences) directed against two or more different antigenic determinants on the same antigen (for example against different epitopes of an antigen and/or against different subunits of a multimeric receptor, channel or protein), the length and flexibility of the linker are preferably such that it allows each NANOBODY® ($V_{HH}$ sequence) to bind to its intended antigenic determinant. Again, based on the disclosure herein, the skilled person will be able to determine the optimal linker(s) for use in a specific polypeptide of the invention, optionally after some limited routine experiments.

It is also within the scope of the invention that the linker(s) used confer one or more other favourable properties or functionality to the polypeptides of the invention, and/or provide one or more sites for the formation of derivatives and/or for the attachment of functional groups (e.g. as described herein for the derivatives of the NANOBODIES® ($V_{HH}$ sequences) of the invention). For example, linkers containing one or more charged amino acid residues (see Table A-2 on page 48 of the International application WO 08/020079) can provide improved hydrophilic properties, whereas linkers that form or contain small epitopes or tags can be used for the purposes of detection, identification and/or purification. Again, based on the disclosure herein, the skilled person will be able to determine the optimal linkers for use in a specific polypeptide of the invention, optionally after some limited routine experiments.

Finally, when two or more linkers are used in the polypeptides of the invention, these linkers may be the same or different. Again, based on the disclosure herein, the skilled person will be able to determine the optimal linkers for use in a specific polypeptide of the invention, optionally after some limited routine experiments.

Usually, for easy of expression and production, a polypeptide of the invention will be a linear polypeptide. However, the invention in its broadest sense is not limited thereto. For example, when a polypeptide of the invention comprises three of more NANOBODIES® ($V_{HH}$ sequences), it is possible to link them by use of a linker with three or more "arms", which each "arm" being linked to a NANOBODY® ($V_{HH}$ sequence), so as to provide a "star-shaped" construct. It is also possible, although usually less preferred, to use circular constructs.

The invention also comprises derivatives of the polypeptides of the invention, which may be essentially analogous to the derivatives of the NANOBODIES® ($V_{HH}$ sequences) of the invention, i.e. as described herein.

The invention also comprises proteins or polypeptides that "essentially consist" of a polypeptide of the invention (in which the wording "essentially consist of" has essentially the same meaning as indicated hereinabove).

According to one aspect of the invention, the polypeptide of the invention is in essentially isolated form, as defined herein.

The amino acid sequences, NANOBODIES® ($V_{HH}$ sequences), polypeptides and nucleic acids of the invention can be prepared in a manner known per se, as will be clear to the skilled person from the further description herein. For example, the NANOBODIES® ($V_{HH}$ sequences) and polypeptides of the invention can be prepared in any manner known per se for the preparation of antibodies and in particular for the preparation of antibody fragments (including but not limited to (single) domain antibodies and ScFv fragments). Some preferred, but non-limiting methods for preparing the amino acid sequences, NANOBODIES® ($V_{HH}$ sequences), polypeptides and nucleic acids include the methods and techniques described herein.

As will be clear to the skilled person, one particularly useful method for preparing an amino acid sequence, NANOBODY® ($V_{HH}$ sequence) and/or a polypeptide of the invention generally comprises the steps of:

i) the expression, in a suitable host cell or host organism (also referred to herein as a "host of the invention") or in another suitable expression system of a nucleic acid that encodes said amino acid sequence, NANOBODY® ($V_{HH}$ sequence) or polypeptide of the invention (also referred to herein as a "nucleic acid of the invention"), optionally followed by:

ii) isolating and/or purifying the amino acid sequence, NANOBODY® ($V_{HH}$ sequence) or polypeptide of the invention thus obtained.

In particular, such a method may comprise the steps of:

i) cultivating and/or maintaining a host of the invention under conditions that are such that said host of the invention expresses and/or produces at least one amino acid sequence, NANOBODY® ($V_{HH}$ sequence) and/or polypeptide of the invention;

optionally followed by:

ii) isolating and/or purifying the amino acid sequence, NANOBODY® ($V_{HH}$ sequence) or polypeptide of the invention thus obtained.

A nucleic acid of the invention can be in the form of single or double stranded DNA or RNA, and is preferably in the form of double stranded DNA. For example, the nucleotide sequences of the invention may be genomic DNA, cDNA or synthetic DNA (such as DNA with a codon usage that has been specifically adapted for expression in the intended host cell or host organism).

According to one aspect of the invention, the nucleic acid of the invention is in essentially isolated form, as defined herein.

The nucleic acid of the invention may also be in the form of, be present in and/or be part of a vector, such as for example a plasmid, cosmid or YAC, which again may be in essentially isolated form.

The nucleic acids of the invention can be prepared or obtained in a manner known per se, based on the information on the amino acid sequences for the polypeptides of the invention given herein, and/or can be isolated from a suitable natural source. To provide analogs, nucleotide sequences encoding naturally occurring $V_{HH}$ domains can for example be subjected to site-directed mutagenesis, so as to provide a nucleic acid of the invention encoding said analog. Also, as will be clear to the skilled person, to prepare a nucleic acid of the invention, also several nucleotide sequences, such as at least one nucleotide sequence encoding a NANOBODY® ($V_{HH}$ sequence) and for example nucleic acids encoding one or more linkers can be linked together in a suitable manner.

Techniques for generating the nucleic acids of the invention will be clear to the skilled person and may for instance include, but are not limited to, automated DNA synthesis; site-directed mutagenesis; combining two or more naturally occurring and/or synthetic sequences (or two or more parts thereof), introduction of mutations that lead to the expression of a truncated expression product; introduction of one or more restriction sites (e.g. to create cassettes and/or regions that may easily be digested and/or ligated using suitable restriction enzymes), and/or the introduction of mutations by means of a PCR reaction using one or more "mismatched" primers, using for example a sequence of a naturally occurring form of an envelope protein of a virus as a template. These and other techniques will be clear to the skilled person, and reference is again made to the standard handbooks, such as Sambrook et al. and Ausubel et al., mentioned above, as well as the Examples below.

The nucleic acid of the invention may also be in the form of, be present in and/or be part of a genetic construct, as will be clear to the person skilled in the art and as described on pages 131-134 of WO 08/020079 (incorporated herein by reference). Such genetic constructs generally comprise at least one nucleic acid of the invention that is optionally linked to one or more elements of genetic constructs known per se, such as for example one or more suitable regulatory elements (such as a suitable promoter(s), enhancer(s), terminator(s), etc.) and the further elements of genetic constructs referred to herein. Such genetic constructs comprising at least one nucleic acid of the invention will also be referred to herein as "genetic constructs of the invention".

The genetic constructs of the invention may be DNA or RNA, and are preferably double-stranded DNA. The genetic constructs of the invention may also be in a form suitable for transformation of the intended host cell or host organism, in a form suitable for integration into the genomic DNA of the intended host cell or in a form suitable for independent replication, maintenance and/or inheritance in the intended host organism. For instance, the genetic constructs of the invention may be in the form of a vector, such as for example a plasmid, cosmid, YAC, a viral vector or transposon. In particular, the vector may be an expression vector, i.e. a vector that can provide for expression in vitro and/or in vivo (e.g. in a suitable host cell, host organism and/or expression system).

In a preferred but non-limiting aspect, a genetic construct of the invention comprises i) at least one nucleic acid of the invention; operably connected to ii) one or more regulatory elements, such as a promoter and optionally a suitable terminator;

and optionally also iii) one or more further elements of genetic constructs known per se;

in which the terms "operably connected" and "operably linked" have the meaning given on pages 131-134 of WO 08/020079; and in which the "regulatory elements", "promoter", "terminator" and "further elements" are as described on pages 131-134 of WO 08/020079; and in which the genetic constructs may further be as described on pages 131-134 of WO 08/020079.

The nucleic acids of the invention and/or the genetic constructs of the invention may be used to transform a host cell or host organism, i.e. for expression and/or production of the amino acid sequence, NANOBODY® ($V_{HH}$ sequence) or polypeptide of the invention. Suitable hosts or host cells will be clear to the skilled person, and may for example be any suitable fungal, prokaryotic or eukaryotic cell or cell line or any suitable fungal, prokaryotic or eukaryotic organism, for example those described on pages 134 and 135 of WO 08/020079; as well as all other hosts or host cells known per se for the expression and production of antibodies and antibody fragments (including but not limited to (single) domain antibodies and ScFv fragments), which will be clear to the skilled person. Reference is also made to the general background art cited hereinabove, as well as to for example WO 94/29457; WO 96/34103; WO 99/42077; Frenken et al., (1998), supra; Riechmann and Muyldermans, (1999), supra; van der Linden, (2000), supra; Thomassen et al., (2002), supra; Joosten et al., (2003), supra; Joosten et al., (2005), supra; and the further references cited herein.

The amino acid sequences, NANOBODIES® ($V_{HH}$ sequences) and polypeptides of the invention can also be introduced and expressed in one or more cells, tissues or organs of a multicellular organism, for example for prophylactic and/or therapeutic purposes (e.g. as a gene therapy), as further described on pages 135 and 136 of in WO 08/020079 and in the further references cited in WO 08/020079.

For expression of the NANOBODIES® ($V_{HH}$ sequences) in a cell, they may also be expressed as so-called "intrabodies", as for example described in WO 94/02610, WO 95/22618 and U.S. Pat. No. 7,004,940; WO 03/014960; in Cattaneo, A. & Biocca, S. (1997) Intracellular Antibodies: Development and Applications. Landes and Springer-Verlag; and in Kontermann, Methods 34, (2004), 163-170.

The amino acid sequences, NANOBODIES® ($V_{HH}$ sequences) and polypeptides of the invention can for example also be produced in the milk of transgenic mammals, for example in the milk of rabbits, cows, goats or sheep (see for example U.S. Pat. No. 6,741,957, U.S. Pat. No. 6,304,489 and U.S. Pat. No. 6,849,992 for general techniques for introducing transgenes into mammals), in plants or parts of plants including but not limited to their leaves, flowers, fruits, seed, roots or tubers (for example in tobacco, maize, soybean or alfalfa) or in for example pupae of the silkworm *Bombix mori.*

Furthermore, the amino acid sequences, NANOBODIES® ($V_{HH}$ sequences) and polypeptides of the invention can also be expressed and/or produced in cell-free expression systems, and suitable examples of such systems will be clear to the skilled person. Some preferred, but non-limiting examples include expression in the wheat germ system; in rabbit reticulocyte lysates; or in the *E. coli* Zubay system.

As mentioned above, one of the advantages of the use of NANOBODIES® ($V_{HH}$ sequences) is that the polypeptides based thereon can be prepared through expression in a suitable bacterial system, and suitable bacterial expression systems, vectors, host cells, regulatory elements, etc., will be clear to the skilled person, for example from the references cited above. It should however be noted that the invention in its broadest sense is not limited to expression in bacterial systems.

Preferably, in the invention, an (in vivo or in vitro) expression system, such as a bacterial expression system, is used that provides the polypeptides of the invention in a form that is suitable for pharmaceutical use, and such expression systems will again be clear to the skilled person. As also will be clear to the skilled person, polypeptides of the invention suitable for pharmaceutical use can be prepared using techniques for peptide synthesis.

For production on industrial scale, preferred heterologous hosts for the (industrial) production of NANOBODIES® ($V_{HH}$ sequences) or NANOBODY® ($V_{HH}$ sequence)-containing protein therapeutics include strains of *E. coli, Pichia pastoris, S. cerevisiae* that are suitable for large scale expression/production/fermentation, and in particular for large scale pharmaceutical (i.e. GMP grade) expression/production/fermentation. Suitable examples of such strains will be clear to the skilled person. Such strains and production/expression systems are also made available by companies such as Biovitrum (Uppsala, Sweden).

Alternatively, mammalian cell lines, in particular Chinese hamster ovary (CHO) cells, can be used for large scale expression/production/fermentation, and in particular for large scale pharmaceutical expression/production/fermentation. Again, such expression/production systems are also made available by some of the companies mentioned above.

The choice of the specific expression system would depend in part on the requirement for certain post-translational modifications, more specifically glycosylation. The production of a NANOBODY® ($V_{HH}$ sequence)-containing recombinant protein for which glycosylation is desired or required would necessitate the use of mammalian expression hosts that have the ability to glycosylate the expressed protein. In this respect, it will be clear to the skilled person that the glycosylation pattern obtained (i.e. the kind, number and position of residues attached) will depend on the cell or cell line that is used for the expression. Preferably, either a human cell or cell line is used (i.e. leading to a protein that essentially has a human glycosylation pattern) or another mammalian cell line is used that can provide a glycosylation pattern that is essentially and/or functionally the same as human glycosylation or at least mimics human glycosylation. Generally, prokaryotic hosts such as *E. coli* do not have the ability to glycosylate proteins, and the use of lower eukaryotes such as yeast usually leads to a glycosylation pattern that differs from human glycosylation. Nevertheless, it should be understood that all the foregoing host cells and expression systems can be used in the invention, depending on the desired amino acid sequence, NANOBODY® ($V_{HH}$ sequence) or polypeptide to be obtained.

Thus, according to one non-limiting aspect of the invention, the amino acid sequence, NANOBODY® ($V_{HH}$ sequence) or polypeptide of the invention is glycosylated. According to another non-limiting aspect of the invention, the amino acid sequence, NANOBODY® ($V_{HH}$ sequence) or polypeptide of the invention is non-glycosylated.

According to one preferred, but non-limiting aspect of the invention, the amino acid sequence, NANOBODY® ($V_{HH}$ sequence) or polypeptide of the invention is produced in a bacterial cell, in particular a bacterial cell suitable for large scale pharmaceutical production, such as cells of the strains mentioned above.

According to another preferred, but non-limiting aspect of the invention, the amino acid sequence, NANOBODY® ($V_{HH}$ sequence) or polypeptide of the invention is produced in a yeast cell, in particular a yeast cell suitable for large scale pharmaceutical production, such as cells of the species mentioned above.

According to yet another preferred, but non-limiting aspect of the invention, the amino acid sequence, NANOBODY® ($V_{HH}$ sequence) or polypeptide of the invention is produced in a mammalian cell, in particular in a human cell or in a cell of a human cell line, and more in particular in a human cell or in a cell of a human cell line that is suitable for large scale pharmaceutical production, such as the cell lines mentioned hereinabove. As further described on pages 138 and 139 of WO 08/020079, when expression in a host cell is used to produce the amino acid sequences, NANOBODIES® ($V_{HH}$ sequences) and the polypeptides of the invention, the amino acid sequences, NANOBODIES® ($V_{HH}$ sequences) and polypeptides of the invention can be produced either intracellularly (e.g. in the cytosol, in the periplasma or in inclusion bodies) and then isolated from the host cells and optionally further purified; or can be produced extracellularly (e.g. in the medium in which the host cells are cultured) and then isolated from the culture medium and optionally further purified. Thus, according to one non-limiting aspect of the invention, the amino acid sequence, NANOBODY® ($V_{HH}$ sequence) or polypeptide of the invention is an amino acid sequence, NANOBODY® ($V_{HH}$ sequence) or polypeptide that has been produced intracellularly and that has been isolated from the host cell, and in particular from a bacterial cell or from an inclusion body in a bacterial cell. According to another non-limiting aspect of the invention, the amino acid sequence, NANOBODY® ($V_{HH}$ sequence) or polypeptide of the invention is an amino acid sequence, NANOBODY® ($V_{HH}$ sequence) or polypeptide that has been produced extracellularly, and that has been isolated from the medium in which the host cell is cultivated.

Some preferred, but non-limiting promoters for use with these host cells include those mentioned on pages 139 and 140 of WO 08/020079.

Some preferred, but non-limiting secretory sequences for use with these host cells include those mentioned on page 140 of WO 08/020079.

Suitable techniques for transforming a host or host cell of the invention will be clear to the skilled person and may depend on the intended host cell/host organism and the genetic construct to be used. Reference is again made to the handbooks and patent applications mentioned above.

After transformation, a step for detecting and selecting those host cells or host organisms that have been successfully transformed with the nucleotide sequence/genetic construct of the invention may be performed. This may for instance be a selection step based on a selectable marker present in the genetic construct of the invention or a step involving the detection of the amino acid sequence of the invention, e.g. using specific antibodies.

The transformed host cell (which may be in the form or a stable cell line) or host organisms (which may be in the form of a stable mutant line or strain) form further aspects of the present invention.

Preferably, these host cells or host organisms are such that they express, or are (at least) capable of expressing (e.g. under suitable conditions), an amino acid sequence, NANOBODY® ($V_{HH}$ sequence) or polypeptide of the invention (and in case of a host organism: in at least one cell, part, tissue or organ thereof). The invention also includes further generations, progeny and/or offspring of the host cell or host organism of the invention, that may for instance be obtained by cell division or by sexual or asexual reproduction.

To produce/obtain expression of the amino acid sequences of the invention, the transformed host cell or transformed host organism may generally be kept, maintained and/or cultured under conditions such that the (desired) amino acid sequence, NANOBODY® ($V_{HH}$ sequence) or polypeptide of the invention is expressed/produced. Suitable conditions will be clear to the skilled person and will usually depend upon the host cell/host organism used, as well as on the regulatory elements that control the expression of the (relevant) nucleotide sequence of the invention. Again, reference is made to the handbooks and patent applications mentioned above in the paragraphs on the genetic constructs of the invention.

Generally, suitable conditions may include the use of a suitable medium, the presence of a suitable source of food and/or suitable nutrients, the use of a suitable temperature, and optionally the presence of a suitable inducing factor or compound (e.g. when the nucleotide sequences of the invention are under the control of an inducible promoter); all of which may be selected by the skilled person. Again, under such conditions, the amino acid sequences of the invention may be expressed in a constitutive manner, in a transient manner, or only when suitably induced.

It will also be clear to the skilled person that the amino acid sequence, NANOBODY® ($V_{HH}$ sequence) or polypeptide of the invention may (first) be generated in an immature form (as mentioned above), which may then be subjected to post-translational modification, depending on the host cell/host organism used. Also, the amino acid sequence, NANOBODY® ($V_{HH}$ sequence) or polypeptide of the invention may be glycosylated, again depending on the host cell/host organism used.

The amino acid sequence, NANOBODY® ($V_{HH}$ sequence) or polypeptide of the invention may then be isolated from the host cell/host organism and/or from the medium in which said host cell or host organism was cultivated, using protein isolation and/or purification techniques known per se, such as (preparative) chromatography and/or electrophoresis techniques, differential precipitation techniques, affinity techniques (e.g. using a specific, cleavable amino acid sequence fused with the amino acid sequence, NANOBODY® ($V_{HH}$ sequence) or polypeptide of the invention) and/or preparative immunological techniques (i.e. using antibodies against the amino acid sequence to be isolated).

Generally, for pharmaceutical use, the polypeptides of the invention may be formulated as a pharmaceutical preparation or compositions comprising at least one polypeptide of the invention and at least one pharmaceutically acceptable carrier, diluent or excipient and/or adjuvant, and optionally one or more further pharmaceutically active polypeptides and/or compounds. By means of non-limiting examples, such a formulation may be in a form suitable for oral administration, for parenteral administration (such as by intravenous, intramuscular or subcutaneous injection or intravenous infusion), for topical administration, for administration by inhalation, by a skin patch, by an implant, by a suppository, etc. Such suitable administration forms—which may be solid, semi-solid or liquid, depending on the manner of administration—as well as methods and carriers for use in the preparation thereof, will be clear to the skilled person, and are further described herein.

Thus, in a further aspect, the invention relates to a pharmaceutical composition that contains at least one amino acid of the invention, at least one NANOBODY® ($V_{HH}$ sequence) of the invention, at least one compound or construct of the invention or at least one polypeptide of the invention and at least one suitable carrier, diluent or excipient (i.e. suitable for pharmaceutical use), and optionally one or more further active substances. Generally, the amino acid sequences, NANOBODIES® ($V_{HH}$ sequences), compounds, constructs and polypeptides of the invention can be formulated and administered in any suitable manner known per se, for which reference is for example made to the general background art cited above (and in particular to WO 04/041862, WO 04/041863, WO 04/041865, WO 04/041867 and WO 08/020079) as well as to the standard handbooks, such as Remington's Pharmaceutical Sciences, $18^{th}$ Ed., Mack Publishing Company, USA (1990), Remington, the Science and Practice of Pharmacy, 21st Edition, Lippincott Williams and Wilkins (2005); or the Handbook of Therapeutic Antibodies (S. Dubel, Ed.), Wiley, Weinheim, 2007 (see for example pages 252-255).

For example, the amino acid sequences, NANOBODIES® ($V_{HH}$ sequences), compounds, constructs and polypeptides of the invention may be formulated and administered in any manner known per se for conventional antibodies and antibody fragments (including ScFv's and diabodies) and other pharmaceutically active proteins. Such formulations and methods for preparing the same will be clear to the skilled person, and for example include preparations suitable for parenteral administration (for example intravenous, intraperitoneal, subcutaneous, intramuscular, intraluminal, intra-arterial or intrathecal administration) or for topical (i.e. transdermal or intradermal) administration.

Preparations for parenteral administration may for example be sterile solutions, suspensions, dispersions or emulsions that are suitable for infusion or injection. Suitable carriers or diluents for such preparations for example include, without limitation, those mentioned on page 143 of WO 08/020079. Usually, aqueous solutions or suspensions will be preferred.

The amino acid sequences, NANOBODIES® ($V_{HH}$ sequences), compounds, constructs and polypeptides of the invention can also be administered using gene therapy methods of delivery. See, e.g., U.S. Pat. No. 5,399,346, which is incorporated by reference in its entirety. Using a gene therapy method of delivery, primary cells transfected with the gene encoding an amino acid sequence, NANOBODY® ($V_{HH}$ sequence) or polypeptide of the invention can additionally be transfected with tissue specific promoters to target specific organs, tissue, grafts, tumors, or cells and can additionally be transfected with signal and stabilization sequences for subcellularly localized expression.

Thus, the amino acid sequences, NANOBODIES® ($V_{HH}$ sequences), compounds, constructs and polypeptides of the invention may be systemically administered, e.g., orally, in combination with a pharmaceutically acceptable vehicle such as an inert diluent or an assimilable edible carrier. They may be enclosed in hard or soft shell gelatin capsules, may be compressed into tablets, or may be incorporated directly with the food of the patient's diet. For oral therapeutic administration, the amino acid sequences, NANOBODIES® ($V_{HH}$ sequences), compounds, constructs and polypeptides of the invention may be combined with one or more excipients and used in the form of ingestible tablets, buccal tablets, troches, capsules, elixirs, suspensions, syrups, wafers, and the like. Such compositions and preparations should contain at least 0.1% of the amino acid sequence, NANOBODY® ($V_{HH}$ sequence), compounds, constructs or polypeptide of the invention. Their percentage in the compositions and preparations may, of course, be varied and may conveniently be between about 2 to about 60% of the weight of a given unit dosage form. The amount of the amino acid sequence, NANOBODY® ($V_{HH}$ sequence), compounds, constructs or polypeptide of the invention in such therapeutically useful compositions is such that an effective dosage level will be obtained.

The tablets, troches, pills, capsules, and the like may also contain binders, excipients, disintegrating agents, lubricants and sweetening or flavouring agents, for example those mentioned on pages 143-144 of WO 08/020079. When the unit dosage form is a capsule, it may contain, in addition to materials of the above type, a liquid carrier, such as a vegetable oil or a polyethylene glycol. Various other materials may be present as coatings or to otherwise modify the physical form of the solid unit dosage form. For instance, tablets, pills, or capsules may be coated with gelatin, wax, shellac or sugar and the like. A syrup or elixir may contain the amino acid sequences, NANOBODIES® ($V_{HH}$ sequences), compounds, constructs and polypeptides of the invention, sucrose or fructose as a sweetening agent, methyl and propylparabens as preservatives, a dye and flavoring such as cherry or orange flavor. Of course, any material used in preparing any unit dosage form should be pharmaceutically acceptable and substantially non-toxic in the amounts employed. In addition, the amino acid sequences, NANOBODIES® ($V_{HH}$ sequences), compounds, constructs and polypeptides of the invention may be incorporated into sustained-release preparations and devices.

Preparations and formulations for oral administration may also be provided with an enteric coating that will allow the constructs of the invention to resist the gastric environment and pass into the intestines. More generally, preparations and formulations for oral administration may be suitably formulated for delivery into any desired part of the gastrointestinal tract. In addition, suitable suppositories may be used for delivery into the gastrointestinal tract.

The amino acid sequences, NANOBODIES® ($V_{HH}$ sequences), compounds, constructs and polypeptides of the invention may also be administered intravenously or intraperitoneally by infusion or injection, as further described on pages 144 and 145 of WO 08/020079.

For topical administration, the amino acid sequences, NANOBODIES® ($V_{HH}$ sequences), compounds, constructs and polypeptides of the invention may be applied in pure form, i.e., when they are liquids. However, it will generally be desirable to administer them to the skin as compositions or formulations, in combination with a dermatologically acceptable carrier, which may be a solid or a liquid, as further described on page 145 of WO 08/020079.

Generally, the concentration of the amino acid sequences, NANOBODIES® ($V_{HH}$ sequences), compounds, constructs and polypeptides of the invention in a liquid composition, such as a lotion, will be from about 0.1-25 wt-%, preferably from about 0.5-10 wt-%. The concentration in a semi-solid or solid composition such as a gel or a powder will be about 0.1-5 wt-%, preferably about 0.5-2.5 wt-%.

In a preferred aspect, the amino acid sequences, NANOBODIES® ($V_{HH}$ sequences), compounds, constructs and/or polypeptides of the invention and/or compositions comprising the same are administered to the pulmonary tissue. In the context of the present invention, "pulmonary tissue" is for the purposes of this invention equivalent with lung tissue or lung. The lung comprises 2 distinct zones: a conducting and a respiratory zone, within which the airway and vascular compartments lie (see e.g. "Pulmonary Drug Delivery", Edited by Karoline Bechtold-Peters and Henrik Luessen, 2007, ISBN 978-3-87193-322-6 pages 16-28).

For pulmonary delivery, the amino acid sequences, NANOBODIES® ($V_{HH}$ sequences), compounds, constructs and polypeptides of the invention may be applied in pure form, i.e., when they are liquids or a dry powder. However, it will be preferred to administer them to the pulmonary tissue as composition or formulation comprising an amino acid sequence, NANOBODY® ($V_{HH}$ sequence), compounds, constructs and/or polypeptide of the invention and a carrier suitable for pulmonary delivery. Accordingly the present invention also relates to a pharmaceutical composition comprising the amino acid sequence, NANOBODY® ($V_{HH}$ sequence), compounds, constructs and/or polypeptide of the invention and a carrier suitable for pulmonary delivery. Carriers suitable for pulmonary delivery are known in the art.

The amino acid sequences, NANOBODIES® ($V_{HH}$ sequences), compounds, constructs and/or polypeptides of the invention may also be administered as micro- or nanoparticles of pure drugs with particle sizes and distributions favorable for pulmonary delivery.

Accordingly the present invention also relates to a pharmaceutical device suitable for the pulmonary delivery of the amino acid sequences, NANOBODIES® ($V_{HH}$ sequences), compounds, constructs and/or polypeptides of the invention and suitable in the use of a composition comprising the same. This device may an inhaler for liquids (e.g. a suspension of fine solid particles or droplets) comprising the amino acid sequence, NANOBODY® ($V_{HH}$ sequence), compounds, constructs and/or polypeptide of the invention. Preferably this device is an aerosol comprising the amino acid sequence, NANOBODY® ($V_{HH}$ sequence), compounds, constructs and/or polypeptide of the invention. The device may also be a dry powder inhaler comprising the amino acid sequence, NANOBODY® ($V_{HH}$ sequence), compounds, constructs and/or polypeptide of the invention in the form of a dry powder.

In a preferred method, the administration to the pulmonary tissue is performed by inhaling the amino acid sequences, NANOBODIES® ($V_{HH}$ sequences), compounds, constructs and/or polypeptides of the invention and/or the composition comprising the same in an aerosol cloud. According to the invention, inhaling of the aerosol cloud can be performed by an inhaler device. The device should generate from a formulation comprising the amino acid sequences, NANOBODIES® ($V_{HH}$ sequences), compounds, constructs and/or polypeptides of the invention and/or composition comprising the same an aerosol cloud of the desired particle size (distribution) at the appropriate moment of the mammal's inhalation cycle, containing the right dose of the amino acid sequences, NANOBODIES® ($V_{HH}$ sequences), compounds, constructs and/or polypeptides of the invention ("Pulmonary drug delivery", Bechtold-Peters and Luessen, eds., ISBN 978-3-87193-322-6, page 125).

In the context of the present invention, "aerosol" denotes a suspension of fine solid particles or liquid droplets (or combination thereof) in a gas wherein for the purposes of this invention the particles and/or droplets comprise the amino acid sequences, NANOBODIES® ($V_{HH}$ sequences), compounds, constructs and/or polypeptides of the invention.

The device should generate from the formulation an aerosol cloud of the desired particle size (distribution) at the appropriate moment of the mammal's inhalation cycle, containing the right dose of amino acid sequences, NANOBODIES® ($V_{HH}$ sequences), compounds, constructs and/or polypeptides of the invention. The following 4 requirements (formulation, particle size, time and dose) should be considered ("Pulmonary Drug Delivery", Bechtold-Peters and Luessen, eds., supra, pages 125 and 126):

The formulations that are used in the devices may vary from aqueous solutions or suspensions used in nebulizers to the propellant-based solutions or suspensions used in metered dose inhaler or even specially engineered powder mixtures for the dry powder inhalers. All these different formulations require different principles for aerosol generation, which emphasizes the mutual dependency of device and formulation;

Since the site of deposition of aerosol particles depends on their (aerodynamic) size and velocity, the desired particle size of the aerosol cloud varies depending on the desired site of deposition in the lung, which is related to the therapeutic goal of the administration;

As the aerosol cloud can be tuned to be released at different moments during the inhalation cycle generated by the mammal, it is preferred that for the agents of the invention (to be deposited in the peripheral parts of the lung) the aerosol is released at the start of the inhalation cycle;

Doses may vary considerably and may e.g. vary e.g. for a human from a few microgram to several hundreds of microgram or even milligrams, e.g. about up to about 10 milligrams.

Various inhalation systems are e.g. described on pages 129 to 148 in the review ("Pulmonary Drug Delivery", Bechtold-Peters and Luessen, eds., supra) and include, but are not limited to, nebulizers, metered dose inhalers, metered dose liquid inhalers, and dry powder inhalers. Devices taking into account optimized and individualized breathing pattern for controlled inhalation maneuvers may also be used (see AKITA® technology on page 157 of "Pulmonary Drug Delivery", Bechtold-Peters and Luessen, eds., supra).

However, not only the device is important to pulmonary delivery of the amino acid sequences, NANOBODIES® ($V_{HH}$ sequences), compounds, constructs and/or polypeptides of the invention but also the right formulation is critical to achieve an effective delivery. This can be in principle achieved by using one of the following approaches:

Administration of aqueous solutions or suspensions comprising the amino acid sequences, NANOBODIES® ($V_{HH}$ sequences), compounds, constructs and/or polypeptides of the invention (e.g. nasal drops) into the nasal cavities;

Nebulisation of aqueous solutions or suspensions comprising the amino acid sequences, NANOBODIES® ($V_{HH}$ sequences), compounds, constructs and/or polypeptides of the invention;

Atomization by means of liquefied propellants; and

Dispersion of dry powders.

Hence formulations of the amino acid sequences, NANOBODIES® ($V_{HH}$ sequences), compounds, constructs and/or polypeptides of the invention have to be adopted and adjusted to the chosen inhalation device. Appropriate formulations, i.e. the excipients in addition to the amino acid sequences, NANOBODIES® ($V_{HH}$ sequences), compounds, constructs and/or polypeptides of the invention, are e.g. described in chapter IV of "Pulmonary Drug Delivery", Bechtold-Peters and Luessen, eds., supra.

The amount of the amino acid sequences, NANOBODIES® ($V_{HH}$ sequences), compounds, constructs and polypeptides of the invention required for use in treatment will vary not only with the particular amino acid sequence, NANOBODY® ($V_{HH}$ sequence), compounds, constructs or polypeptide selected but also with the route of administration, the nature of the condition being treated and the age and condition of the patient and will be ultimately at the discretion of the attendant physician or clinician. Also the dosage of the amino acid sequences, NANOBODIES® ($V_{HH}$ sequences), compounds, constructs and polypeptides of the invention varies depending on the target host cell, tumor, tissue, graft, or organ.

The desired dose may conveniently be presented in a single dose or as divided doses administered at appropriate intervals, for example, as two, three, four or more sub-doses per day. The sub-dose itself may be further divided, e.g., into a number of discrete loosely spaced administrations; such as multiple inhalations from an insufflator or by application of a plurality of drops into the eye.

An administration regimen could include long-term, daily treatment. By "long-term" is meant at least two weeks and preferably, several weeks, months, or years of duration. Necessary modifications in this dosage range may be determined by one of ordinary skill in the art using only routine experimentation given the teachings herein. See Remington's Pharmaceutical Sciences (Martin, E. W., ed. 4), Mack Publishing Co., Easton, Pa. The dosage can also be adjusted by the individual physician in the event of any complication.

In another aspect, the invention relates to a method for the prevention and/or treatment of at least one viral disease, said method comprising administering, to a subject in need thereof, a pharmaceutically active amount of an amino acid sequence of the invention, of a NANOBODY® ($V_{HH}$ sequence) of the invention, of a polypeptide of the invention, of a compound or construct of the invention and/or of a pharmaceutical composition comprising the same.

In the context of the present invention, the term "prevention and/or treatment" not only comprises preventing and/or treating the disease, but also generally comprises preventing the onset of the disease, slowing or reversing the progress of disease, preventing or slowing the onset of one or more symptoms associated with the disease, reducing and/or alleviating one or more symptoms associated with the disease, reducing the severity and/or the duration of the disease and/or of any symptoms associated therewith and/or preventing a further increase in the severity of the disease and/or of any symptoms associated therewith, preventing, reducing or reversing any physiological damage caused by the disease, and generally any pharmacological action that is beneficial to the patient being treated.

The subject to be treated may be any warm-blooded animal, but is in particular a mammal, and more in particular a human being. As will be clear to the skilled person, the subject to be treated will in particular be a person suffering from, or at risk of, the diseases and disorders mentioned herein.

The invention relates to a method for the prevention and/or treatment of at least one disease or disorder that is associated with viral entry and/or viral replication and/or mediated by an envelope protein of a virus and/or its viral receptor, with its biological or pharmacological activity, and/or with the viral-mediated biological pathways in which an envelope protein of a virus and/or its viral receptor is involved, said method comprising administering, to a subject in need thereof, a pharmaceutically active amount of an amino acid sequence of the invention, of a NANOBODY® ($V_{HH}$ sequence) of the invention, of a polypeptide of the invention, of a compound or construct of the invention and/or of a pharmaceutical composition comprising the same. In particular, the invention relates to a method for the prevention and/or treatment of at least one disease or disorder that can be treated by modulating and in particular inhibiting and/or preventing the viral-mediated biological pathways in which an envelope protein of a virus and/or a viral receptor are involved, said method comprising administering, to a subject in need thereof, a pharmaceutically active amount of an amino acid sequence of the invention, of a NANOBODY® ($V_{HH}$ sequence) of the invention, of a polypeptide of the invention, of a compound or construct of the invention and/or of a pharmaceutical composition comprising the same. In particular, the invention relates to a method for the prevention and/or treatment of at least one disease or disorder that can be treated by neutralizing a virus (as defined herein) and/or modulating, reducing and/or inhibiting the infectivity of a virus (as defined herein), said method comprising administering, to a subject in need thereof, a pharmaceutically active amount of an amino acid sequence of the invention, of a NANOBODY® ($V_{HH}$ sequence) of the invention, of a polypeptide of the invention, of a compound or construct of the invention and/or of a pharmaceutical composition comprising the same. Said pharmaceutically effective amount may be an amount that is sufficient to modulate and in particular inhibit and/or prevent the viral-mediated biological pathways in which an envelope protein of a virus and/or a viral receptor are involved; and/or an amount that provides a level of the amino acid sequence of the invention, of a NANOBODY® ($V_{HH}$ sequence) of the invention, of a polypeptide of the invention, of compound or construct of the invention in the circulation that is sufficient to modulate and in particular inhibit and/or prevent the viral-mediated biological pathways in which an envelope protein of a virus and/or a viral receptor are involved.

More specifically, said method for the prevention and/or treatment of at least one disease or disorder that may comprise neutralizing a virus (as defined herein) and/or modulating, reducing and/or inhibiting the infectivity of a virus (as defined herein) in the pre-entry phase of viral infection (i.e. before and/or during viral entry in a target host cell has taken place) and/or in the post-entry phase of viral infection (i.e. after viral entry in a target host cell has taken place). Accordingly, said method for the prevention and/or treatment of at least one disease or disorder that may comprise neutralizing a virus (as defined herein) and/or modulating, reducing and/or inhibiting the infectivity of a virus (as defined herein) in the pre-entry phase of viral infection (i.e. before and/or during viral entry in a target host cell has taken place), is said herein to comprise modulating and in particular inhibiting and/or preventing viral entry (as further defined herein) in a target host cell. Furthermore, said method for the prevention and/or treatment of at least one disease or disorder that may comprise neutralizing a virus (as defined herein) and/or modulating, reducing and/or inhibiting the infectivity of a virus (as defined herein) in the post-entry phase of viral infection (i.e. after viral entry in a target host cell has taken place), is said herein to comprise modulating and in particular inhibiting and/or preventing viral replication (as further defined herein) in a target host cell.

Accordingly, the present invention relates to a method for the prevention and/or treatment of at least one disease or disorder that can be treated by modulating and in particular inhibiting and/or preventing viral entry and/or viral replication in a target host cell by specifically binding to an envelope protein of a virus at any suitable stage of said biological pathway(s); preferably, the method of the present invention can comprise modulating and in particular inhibiting and/or preventing viral entry in a target host cell by binding to an envelope protein of a virus, such that virion aggregation is induced and/or virion structure is destabilized and/or virion attachment to a target host cell is modulated, inhibited and/or prevented (for instance by modulating and/or inhibiting and/or preventing the interaction between the envelope protein of a virus and a viral receptor on a target host cell or by competing with said envelope protein for binding to said viral receptor) and/or viral fusion with said target host cell is modulated, inhibited and/or prevented (for instance at the target host cell membrane or within an endosomal and/or lysosomal compartment of said target host cell), for example by preventing said envelope protein of a virus from undergoing a conformational change. Alternatively, the method of the present invention can comprise modulating and in particular inhibiting and/or preventing viral replication (as defined herein) in a target host cell by specifically binding to an envelope protein of a virus at any suitable stage of said biological pathway; preferably, the method of the present invention can comprise modulating and in particular inhibiting and/or preventing viral replication in a target host cell by binding to an envelope protein of a virus, such that transcription and/or translation of the viral genome is affected, inhibited and/or prevented and/or viral packaging and/or the formation of functional virions is affected, inhibited and/or prevented and/or budding of nascent virions from the target host cell membrane is reduced, inhibited and/or prevented.

The invention furthermore relates to a method for the prevention and/or treatment of at least one disease or disorder that can be prevented and/or treated by administering an amino acid sequence of the invention, a NANOBODY® ($V_{HH}$ sequence) of the invention, a compound or construct of the invention or a polypeptide of the invention to a patient, said method comprising administering, to a subject in need thereof, a pharmaceutically active amount of an amino acid sequence of the invention, of a NANOBODY® ($V_{HH}$ sequence) of the invention, of a polypeptide of the invention, of a compound or construct of the invention and/or of a pharmaceutical composition comprising the same.

More in particular, the invention may relate to a method for the prevention and/or treatment of at least one viral infection, said method comprising administering to a subject in need thereof, a pharmaceutically active amount of an amino acid sequence of the invention, of a NANOBODY® ($V_{HH}$ sequence) of the invention, of a polypeptide of the invention, of a compound or construct of the invention and/or of a pharmaceutical composition comprising the same.

More in particular, the invention relates to a method for the prevention and/or treatment of at least one disease or disorder chosen from the group consisting of the diseases and disorders listed herein, said method comprising administering, to a subject in need thereof, a pharmaceutically active amount of an amino acid sequence of the invention, of a NANOBODY® ($V_{HH}$ sequence) of the invention, of a polypeptide of the invention, of a compound or construct of the invention and/or of a pharmaceutical composition comprising the same.

More in particular, the present invention may relate to a method for the prevention and/or treatment of infection by RSV, influenza or rabies, said method comprising administering, to a subject in need thereof, a pharmaceutically active amount of an amino acid sequence of the invention, of a NANOBODY® ($V_{HH}$ sequence) of the invention, of a polypeptide of the invention, of a compound or construct of the invention and/or of a pharmaceutical composition comprising the same.

More in particular, the present invention may relate to a method for the prevention and/or treatment of infection by RSV, influenza or rabies, said method comprising administering, to a subject in need thereof, a pharmaceutically active amount of a multivalent (e.g. trivalent, bivalent, triparatopic, biparatopic, trivalent biparatopic) amino acid sequence of the invention, of a multivalent (e.g. trivalent, bivalent, triparatopic, biparatopic, trivalent biparatopic) NANOBODY® ($V_{HH}$ sequence) of the invention, of a multivalent (e.g. trivalent, bivalent, triparatopic, biparatopic, trivalent biparatopic) polypeptide of the invention, of a multivalent (e.g. trivalent, bivalent, triparatopic, biparatopic, trivalent biparatopic) compound or construct of the invention and/or of a pharmaceutical composition comprising the same.

More in particular, the present invention may relate to a method for the prevention and/or treatment of infection by RSV, said method comprising administering, to a subject in need thereof, a pharmaceutically active amount of a multivalent (e.g. trivalent, bivalent, triparatopic, biparatopic, trivalent biparatopic) amino acid sequence of the invention, of a multivalent (e.g. trivalent, bivalent, triparatopic, biparatopic, trivalent biparatopic) NANOBODY® ($V_{HH}$ sequence) of the invention, of a multivalent (e.g. trivalent, bivalent, triparatopic, biparatopic, trivalent biparatopic) polypeptide of the invention, of a multivalent (e.g. trivalent, bivalent, triparatopic, biparatopic, trivalent biparatopic) compound or construct of the invention and/or of a pharmaceutical composition comprising the same. More in particular, the present invention may relate to a method for the prevention and/or treatment of infection by RSV, said method comprising administering, to a subject in need thereof, a pharmaceutically active amount of a trivalent amino acid sequence, NANOBODY® ($V_{HH}$ sequence), compound or construct or polypeptide of the invention. More in particular, the present invention may relate to a method for the prevention and/or treatment of infection by RSV, said method comprising administering, to a subject in need thereof, a pharmaceutically active amount of a bivalent NC41 NANOBODY® ($V_{HH}$ sequence) (such as e.g. SEQ ID NO: 2395). More in particular, the present invention may relate to a method for the prevention and/or treatment of infection by RSV, said method comprising administering, to a subject in need thereof, a pharmaceutically active amount of a trivalent NC41 NANOBODY® ($V_{HH}$ sequence) (such as e.g. one of SEQ ID NO's: 2415 and 2989 to 2998).

More in particular, the present invention may relate to a method for the prevention and/or treatment of infection by influenza, said method comprising administering, to a subject in need thereof, a pharmaceutically active amount of a multivalent (e.g. trivalent, bivalent, triparatopic, biparatopic, trivalent biparatopic) amino acid sequence of the invention, of a multivalent (e.g. trivalent, bivalent, triparatopic, biparatopic, trivalent biparatopic) NANOBODY® ($V_{HH}$ sequence) of the invention, of a multivalent (e.g. trivalent, bivalent, triparatopic, biparatopic, trivalent biparatopic) polypeptide of the invention, of a multivalent (e.g. trivalent, bivalent, triparatopic, biparatopic, trivalent biparatopic) compound or construct of the invention and/or of a pharmaceutical composition comprising the same. More in particular, the present invention may relate to a method for the prevention and/or treatment of infection by influenza, said method comprising administering, to a subject in need thereof, a pharmaceutically active amount of a trivalent amino acid sequence, NANOBODY® ($V_{HH}$ sequence), compound or construct or polypeptide of the invention. More in particular, the present invention may relate to a method for the prevention and/or treatment of infection by influenza, said method comprising administering, to a subject in need thereof, a pharmaceutically active amount of a bivalent 202-C8 NANOBODY® ($V_{HH}$ sequence) (such as e.g. one of SEQ ID NO's: 2423 and 2424). More in particular, the present invention may relate to a method for the prevention and/or treatment of infection by influenza, said method comprising administering, to a subject in need thereof, a pharmaceutically active amount of a trivalent 202-C8 NANOBODY® ($V_{HH}$ sequence) (such as e.g. one of SEQ ID NO's: 2425 and 2426). More in particular, the present invention may relate to a method for the prevention and/or treatment of infection by influenza H1N1 (more in particular swine flu H1N1), said method comprising administering, to a subject in need thereof, a pharmaceutically active amount of a multivalent (e.g. trivalent, bivalent, triparatopic, biparatopic, trivalent biparatopic) amino acid sequence of the invention, of a multivalent (e.g. trivalent, bivalent, triparatopic, biparatopic, trivalent biparatopic) NANOBODY® ($V_{HH}$ sequence) of the invention, of a multivalent (e.g. trivalent, bivalent, triparatopic, biparatopic, trivalent biparatopic) compound or construct of the invention, of a multivalent (e.g. trivalent, bivalent, triparatopic, biparatopic, trivalent biparatopic) polypeptide of the invention, more particularly a bivalent 202-C8 NANOBODY® ($V_{HH}$ sequence) (such as e.g. one of SEQ ID NO's: 2423 and 2424) or a trivalent 202-C8 NANOBODY® ($V_{HH}$ sequence) (such as e.g. one of SEQ ID NO's: 2425 and 2426).

More in particular, the present invention may relate to a method for the prevention and/or treatment of infection by rabies, said method comprising administering, to a subject in need thereof, a pharmaceutically active amount of a multivalent (e.g. trivalent, bivalent, triparatopic, biparatopic, trivalent biparatopic) amino acid sequence of the invention, of a multivalent (e.g. trivalent, bivalent, triparatopic, biparatopic, trivalent biparatopic) NANOBODY® ($V_{HH}$ sequence) of the invention, of a multivalent (e.g. trivalent, bivalent, triparatopic, biparatopic, trivalent biparatopic) polypeptide of the invention, of a multivalent (e.g. trivalent, bivalent, triparatopic, biparatopic, trivalent biparatopic) compound or construct of the invention and/or of a pharmaceutical composition comprising the same. More in particular, the present invention may relate to a method for the prevention and/or treatment of infection by rabies, said method comprising administering, to a subject in need thereof, a pharmaceutically active amount of a bivalent or biparatopic amino acid sequence, NANOBODY® ($V_{HH}$ sequence), compound or construct or polypeptide of the invention. More in particular, the present invention may relate to a method for the prevention and/or treatment of infection by rabies, said method comprising administering, to a subject in need thereof, a pharmaceutically active amount of a bivalent or biparatopic NANOBODY® ($V_{HH}$ sequence) as described in Example 50.

More in particular, the present invention may relate to a method for the prevention and/or treatment of infection by RSV, influenza or rabies, said method comprising administering to the pulmonary tissue of a subject in need thereof, a pharmaceutically active amount of an amino acid sequence of the invention, of a NANOBODY® ($V_{HH}$ sequence) of the invention, of a polypeptide of the invention, and/or of a pharmaceutical composition comprising the same.

In another aspect, the invention relates to a method for immunotherapy, and in particular for passive immunotherapy, which method comprises administering, to a subject suffering from or at risk of the diseases and disorders mentioned herein, a pharmaceutically active amount of an amino acid sequence of the invention, of a NANOBODY® ($V_{HH}$ sequence) of the invention, of a polypeptide of the invention, of a compound or construct of the invention and/or of a pharmaceutical composition comprising the same.

In the above methods, the amino acid sequences, NANOBODIES® ($V_{HH}$ sequences), compounds or constructs and/or polypeptides of the invention and/or the compositions comprising the same can be administered in any suitable manner, depending on the specific pharmaceutical formulation or composition to be used. Thus, the amino acid sequences, NANOBODIES® ($V_{HH}$ sequences) and/or polypeptides of the invention and/or the compositions comprising the same can for example be administered orally, intraperitoneally (e.g. intravenously, subcutaneously, intramuscularly, or via any other route of administration that circumvents the gastrointestinal tract), intranasally, transdermally, topically, by means of a suppository, by inhalation, again depending on the specific pharmaceutical formulation or composition to be used. The clinician will be able to select a suitable route of administration and a suitable pharmaceutical formulation or composition to be used in such administration, depending on the disease or disorder to be prevented or treated and other factors well known to the clinician.

Thus, in general, the amino acid sequences, NANOBODIES® ($V_{HH}$ sequences), compounds or constructs and polypeptides according to the invention that are directed against an envelope protein of a virus and/or the compositions comprising the same can be administered in any suitable manner; for example but not limited thereto, the amino acid sequences, NANOBODIES® ($V_{HH}$ sequences), compounds or constructs and polypeptides according to the invention and compositions comprising the same that are directed against an envelope protein of a virus (such as e.g. RSV virus, influenza virus or rabies virus) can be administered intranasally and/or by inhalation and/or by any other suitable form of pulmonary delivery; methods for pulmonary delivery and/or intranasal delivery and/or delivery by inhalation of a NANOBODY® ($V_{HH}$ sequence), amino acid sequence, compound or construct and/or polypeptide of the invention will be known to the skilled person and are e.g. described in the handbook "Drug Delivery: Principles and Applications" (2005) by Binghe Wang, Teruna Siahaan and Richard Soltero (Eds. Wiley Interscience (John Wiley & Sons)); in the International application WO 08/049897 of Ablynx N.V. entitled "Intranasal delivery of polypeptides and proteins"; in "Pharmacology PreTest™ Self-Assessment and Review" ($11^{th}$ Edition) by Rosenfeld G. C., Loose-Mitchell D. S.; and in "Pharmacology" (3rd Edition) by Lippincott Williams & Wilkins, New York; Shlafer M. McGraw-Hill Medical Publishing Division, New York; Yang K. Y., Graff L. R., Caughey A. B. Blueprints Pharmacology, Blackwell Publishing.

Accordingly, the present invention also relates to a method for administering an effective amount of a amino acid sequence, NANOBODY® ($V_{HH}$ sequence), compound or construct and/or polypeptide of the invention, directed against an envelope protein of a virus (such as an envelope protein of RSV virus, of influenza virus or of rabies virus) and/or a composition comprising the same, wherein said method comprises the step of administering the amino acid sequence, NANOBODY® ($V_{HH}$ sequence), compound or construct and/or polypeptide and/or composition comprising the same to the pulmonary tissue. In such method, the amino acid sequence, NANOBODY® ($V_{HH}$ sequence), compound or construct and/or polypeptide and/or a composition comprising the same can be administered by any method know in the art for pulmonary delivery such as e.g. by use of an inhaler or intranasal delivery device or aerosol.

In one aspect of the invention, the amino acid sequence, NANOBODY® ($V_{HH}$ sequence), compound or construct and/or polypeptide will bind and/or neutralize virus present in the pulmonary tissue. Viruses that are present in and/or infect the pulmonary tissue are known in the art and include for example, without being limiting influenza virus, RSV, rhinoviruses (see also Fields Virology, Fifth edition, Editors in chief: David-M Knipe, Peter M. Howley, Wolters Kluwer/lipincot Williams & Wilkins, 2007). Preferably in such method for pulmonary delivery at least 5%, preferably at least 10%, 20%, 30%, 40%, more preferably at least 50%, 60%, 70%, and even more preferably at least 80% or more of the amino acid sequence, NANOBODY® ($V_{HH}$ sequence), compound or construct and/or polypeptide of the invention is stable in the pulmonary tissue for at least 24 hours, preferably at least 48 hours more preferably at least 72 hours.

It has been surprisingly found that the amino acid sequences, NANOBODIES® ($V_{HH}$ sequences), compounds or constructs and/or polypeptides of the invention have a long lasting stability in the pulmonary tissue. E.g. it has been found that a NANOBODY® ($V_{HH}$ sequence) directed against RSV remains functional in the lung for at least 48 hours (see experimental part). Thus, embodiments of the invention with treatment intervals such as once a day, once every $2^{nd}$, $3^{rd}$, $4^{th}$, $5^{th}$, $6^{th}$ or once every week are thought to be possible taken the estimated long lasting stability of the amino acid sequences, NANOBODIES® ($V_{HH}$ sequences), compounds or constructs and/or polypeptides of the invention.

Accordingly, the invention relates to a method for delivering an amino acid sequence, NANOBODY® ($V_{HH}$ sequence), compound or construct and/or polypeptide of the invention to the pulmonary tissue of a subject without being inactivated, said method comprising the step of pulmonary administering said amino acid sequence, NANOBODY® ($V_{HH}$ sequence), compound or construct and/or polypeptide of the invention to said subject.

In another aspect of the invention the amino acid sequence, NANOBODY® ($V_{HH}$ sequence), compound or construct and/or polypeptide is capable of providing a systemic therapeutic or biological activity. In this aspect, the amino acid sequence, NANOBODY® ($V_{HH}$ sequence), compound or construct and/or polypeptide will enter the bloodstream and bind and/or neutralize virus present in the blood, following pulmonar administration of the amino acid sequence, NANOBODY® ($V_{HH}$ sequence), compound or construct and/or polypeptide and/or composition comprising the same. Virus that infect non-pulmonary tissues are known in the art and include, for example but without being limiting, Hepatitis, Herpes simplex I and II, Epstein-Barr virus, Cytomegalovirus, West Nile Virus, Rabies virus, Enteroviruses (polioviruses, Coxcackieviruses) (see also Fields Virology, Fifth edition, Editors in chief: David-M. Knipe, Peter M. Howley, Wolters Kluwer/lipincot Williams & Wilkins, 2007). Preferably in such method of pulmonary delivery the bioavailability for the amino acid sequence, NANOBODY® ($V_{HH}$ sequence), compound or construct and/or polypeptide of the invention is at least 1%, preferably at least 2%, 5%, 10%, 20%, 30%, 40%, more preferably at least 50%, 60%, 70%, and even more preferably at least 80% or more compared to parenteral administration of said NANOBODY® ($V_{HH}$ sequence), polypeptide or protein.

Accordingly, the invention relates to a method for delivering an amino acid sequence, NANOBODY® ($V_{HH}$ sequence), compound or construct and/or polypeptide of the invention to the bloodstream of a subject without being inactivated, said method comprising the step of pulmonary administering said amino acid sequence, NANOBODY® ($V_{HH}$ sequence), compound or construct and/or polypeptide of the invention to said subject.

The invention also relates to a method for the prevention and/or treatment of at least one viral infection, said method comprising administering to the pulmonary tissue of a subject in need thereof, a pharmaceutically active amount of an amino acid sequence of the invention, of a NANOBODY® ($V_{HH}$ sequence) of the invention, of a polypeptide of the invention, of a compound or construct of the invention and/or of a pharmaceutical composition comprising the same.

More in particular, the invention relates to a method for the prevention and/or treatment of at least one disease or disorder chosen from the group consisting of the diseases and disorders listed herein, said method comprising administering, to the pulmonary tissue of a subject in need thereof, a pharmaceutically active amount of an amino acid sequence of the invention, of a NANOBODY® ($V_{HH}$ sequence) of the invention, of a polypeptide of the invention, of a compound or construct of the invention and/or of a pharmaceutical composition comprising the same.

More in particular, the present invention may relate to a method for the prevention and/or treatment of infection by RSV, influenza or rabies, said method comprising administering, to the pulmonary tissue of a subject in need thereof, a pharmaceutically active amount of an amino acid sequence of the invention, of a NANOBODY® ($V_{HH}$ sequence) of the invention, of a polypeptide of the invention, of a compound or construct of the invention and/or of a pharmaceutical composition comprising the same.

More in particular, the present invention may relate to a method for the prevention and/or treatment of infection by RSV, influenza or rabies, said method comprising administering, to the pulmonary tissue of a subject in need thereof, a pharmaceutically active amount of a multivalent (e.g. trivalent, bivalent, triparatopic, biparatopic, trivalent biparatopic) amino acid sequence of the invention, of a multivalent (e.g. trivalent, bivalent, triparatopic, biparatopic, trivalent biparatopic) NANOBODY® ($V_{HH}$ sequence) of the invention, of a multivalent (e.g. trivalent, bivalent, triparatopic, biparatopic, trivalent biparatopic) polypeptide of the invention, of a multivalent (e.g. trivalent, bivalent, triparatopic, biparatopic, trivalent biparatopic) compound or construct of the invention and/or of a pharmaceutical composition comprising the same.

More in particular, the present invention may relate to a method for the prevention and/or treatment of infection by RSV, said method comprising administering, to the pulmonary tissue of a subject in need thereof, a pharmaceutically active amount of a multivalent (e.g. trivalent, bivalent, triparatopic, biparatopic, trivalent biparatopic) amino acid sequence of the invention, of a multivalent (e.g. trivalent, bivalent, triparatopic, biparatopic, trivalent biparatopic) NANOBODY® ($V_{HH}$ sequence) of the invention, of a multivalent (e.g. trivalent, bivalent, triparatopic, biparatopic, trivalent biparatopic) polypeptide of the invention, of a multivalent (e.g. trivalent, bivalent, triparatopic, biparatopic, trivalent biparatopic) compound or construct of the invention and/or of a pharmaceutical composition comprising the same. More in particular, the present invention may relate to a method for the prevention and/or treatment of infection by RSV, said method comprising administering, to the pulmonary tissue of a subject in need thereof, a pharmaceutically active amount of a trivalent amino acid sequence, NANOBODY® ($V_{HH}$ sequence), compound or construct or polypeptide of the invention. More in particular, the present invention may relate to a method for the prevention and/or treatment of infection by RSV, said method comprising administering, to the pulmonary tissue of a subject in need thereof, a pharmaceutically active amount of a bivalent NC41 NANOBODY® ($V_{HH}$ sequence) (such as e.g. SEQ ID NO: 2395). More in particular, the present invention may relate to a method for the prevention and/or treatment of infection by RSV, said method comprising administering, to the pulmonary tissue of a subject in need thereof, a pharmaceutically active amount of a trivalent NC41 NANOBODY® ($V_{HH}$ sequence) (such as e.g. one of SEQ ID NO's: 2415 and 2989 to 2998).

More in particular, the present invention may relate to a method for the prevention and/or treatment of infection by influenza, said method comprising administering, to the pulmonary tissue of a subject in need thereof, a pharmaceutically active amount of a multivalent (e.g. trivalent, bivalent, triparatopic, biparatopic, trivalent biparatopic) amino acid sequence of the invention, of a multivalent (e.g. trivalent, bivalent, triparatopic, biparatopic, trivalent biparatopic) NANOBODY® ($V_{HH}$ sequence) of the invention, of a multivalent (e.g. trivalent, bivalent, triparatopic, biparatopic, trivalent biparatopic) polypeptide of the invention, of a multivalent (e.g. trivalent, bivalent, triparatopic, biparatopic, trivalent biparatopic) compound or construct of the invention and/or of a pharmaceutical composition comprising the same. More in particular, the present invention may relate to a method for the prevention and/or treatment of infection by influenza, said method comprising administering, to the pulmonary tissue of a subject in need thereof, a pharmaceutically active amount of a trivalent amino acid sequence, NANOBODY® ($V_{HH}$ sequence), compound or construct or polypeptide of the invention. More in particular, the present invention may relate to a method for the prevention and/or treatment of infection by influenza, said method comprising administering, to the pulmonary tissue of a subject in need thereof, a pharmaceutically active amount of a bivalent 202-C8 NANOBODY® ($V_{HH}$ sequence) (such as e.g. one of SEQ ID NO's: 2423 and 2424). More in particular, the present invention may relate to a method for the prevention and/or treatment of infection by influenza, said method comprising administering, to the pulmonary tissue of a subject in need thereof, a pharmaceutically active amount of a trivalent 202-C8 NANOBODY® ($V_{HH}$ sequence) (such as e.g. one of SEQ ID NO's: 2425 and 2426). More in particular, the present invention may relate to a method for the prevention and/or treatment of infection by influenza H1N1 (more in particular swine flu H1N1), said method comprising administering, to the pulmonary tissue of a subject in need thereof, a pharmaceutically active amount of a multivalent (e.g. trivalent, bivalent, triparatopic, biparatopic, trivalent biparatopic) amino acid sequence of the invention, of a multivalent (e.g. trivalent, bivalent, triparatopic, biparatopic, trivalent biparatopic) NANOBODY® ($V_{HH}$ sequence) of the invention, of a multivalent (e.g. trivalent, bivalent, triparatopic, biparatopic, trivalent biparatopic) compound or construct of the invention, of a multivalent (e.g. trivalent, bivalent, triparatopic, biparatopic, trivalent biparatopic) polypeptide of the invention, more particularly a bivalent 202-C8 NANOBODY® ($V_{HH}$ sequence) (such as e.g. one of SEQ ID NO's: 2423 and 2424) or a trivalent 202-C8 NANOBODY® ($V_{HH}$ sequence) (such as e.g. one of SEQ ID NO's: 2425 and 2426).

More in particular, the present invention may relate to a method for the prevention and/or treatment of infection by rabies, said method comprising administering, to the pulmonary tissue of a subject in need thereof, a pharmaceutically active amount of a multivalent (e.g. trivalent, bivalent, triparatopic, biparatopic, trivalent biparatopic) amino acid sequence of the invention, of a multivalent (e.g. trivalent, bivalent, triparatopic, biparatopic, trivalent biparatopic) NANOBODY® ($V_{HH}$ sequence) of the invention, of a multivalent (e.g. trivalent, bivalent, triparatopic, biparatopic, trivalent biparatopic) polypeptide of the invention, of a multivalent (e.g. trivalent, bivalent, triparatopic, biparatopic, trivalent biparatopic) compound or construct of the invention and/or of a pharmaceutical composition comprising the same. More in particular, the present invention may relate to a method for the prevention and/or treatment of infection by rabies, said method comprising administering, to the pulmonary tissue of a subject in need thereof, a pharmaceutically active amount of a bivalent or biparatopic amino acid sequence, NANOBODY® ($V_{HH}$ sequence), compound or construct or polypeptide of the invention. More in particular, the present invention may relate to a method for the prevention and/or treatment of infection by rabies, said method comprising administering, to the pulmonary tissue of a subject in need thereof, a pharmaceutically active amount of a bivalent or biparatopic NANOBODY® ($V_{HH}$ sequence) as described in Example 50.

Also for example but not limited thereto, the amino acid sequences, NANOBODIES® ($V_{HH}$ sequences), compounds or constructs, and polypeptides according to the invention and compositions comprising the same, that are directed against an envelope protein of rabies virus can be administered intramuscularly and/or by any suitable form of delivery to the brain, such as any suitable form of delivery which allows said amino acid sequences, NANOBODIES® ($V_{HH}$ sequences), polypeptides, compounds or constructs and compositions comprising the same to be transported across the blood-brain-barrier. Such methods for intramuscular delivery and/or any suitable form of delivery to the brain of a NANOBODY® ($V_{HH}$ sequence), amino acid sequence and/or polypeptide of the invention will be known to the skilled person and are e.g. described in the handbook "Drug Delivery: Principles and Applications" (2005) by Binghe Wang, Teruna Siahaan and Richard Soltero (Eds. Wiley Interscience (John Wiley & Sons)); in "Pharmacology PreTest™ Self-Assessment and Review" ($11^{th}$ Edition) by Rosenfeld G. C., Loose-Mitchell D. S.; and in "Pharmacology" (3rd Edition) by Lippincott Williams & Wilkins, New York; Shlafer M. McGraw-Hill Medical Publishing Division, New York; Yang K. Y., Graff L. R., Caughey A. B. Blueprints Pharmacology, Blackwell Publishing.

The amino acid sequences, NANOBODIES® ($V_{HH}$ sequences), compounds or constructs and/or polypeptides of the invention and/or the compositions comprising the same are administered according to a regime of treatment that is suitable for preventing and/or treating the disease or disorder to be prevented or treated. The clinician will generally be able to determine a suitable treatment regimen, depending on factors such as the disease or disorder to be prevented or treated, the severity of the disease to be treated and/or the severity of the symptoms thereof, the specific amino acid sequence, NANOBODY® ($V_{HH}$ sequence), compound or construct or polypeptide of the invention to be used, the specific route of administration and pharmaceutical formulation or composition to be used, the age, gender, weight, diet, general condition of the patient, and similar factors well known to the clinician.

Generally, the treatment regimen will comprise the administration of one or more amino acid sequences, NANOBODIES® ($V_{HH}$ sequences), compounds or constructs and/or polypeptides of the invention, or of one or more compositions comprising the same, in one or more pharmaceutically effective amounts or doses. The specific amount(s) or doses to administered can be determined by the clinician, again based on the factors cited above.

Generally, for the prevention and/or treatment of the diseases and disorders mentioned herein and depending on the specific disease or disorder to be treated, the potency of the specific amino acid sequence, NANOBODY® ($V_{HH}$ sequence), compound or construct and polypeptide of the invention to be used, the specific route of administration and the specific pharmaceutical formulation or composition used, the amino acid sequences, NANOBODIES® ($V_{HH}$ sequences), compounds or constructs and polypeptides of the invention will generally be administered in an amount between 1 gram and 0.01 microgram per kg body weight per day, preferably between 0.1 gram and 0.1 microgram per kg body weight per day, such as about 1, 10, 100 or 1000 microgram per kg body weight per day, either continuously (e.g. by infusion), as a single daily dose or as multiple divided doses during the day. The clinician will generally be able to determine a suitable daily dose, depending on the factors mentioned herein. It will also be clear that in specific cases, the clinician may choose to deviate from these amounts, for example on the basis of the factors cited above and his expert judgment. Generally, some guidance on the amounts to be administered can be obtained from the amounts usually administered for comparable conventional antibodies or antibody fragments against the same target administered via essentially the same route, taking into account however differences in affinity/avidity, efficacy, biodistribution, half-life and similar factors well known to the skilled person.

When the amino acid sequence, NANOBODY® ($V_{HH}$ sequence), compound or construct and/or polypeptide and/or a composition comprising the same is administered to the pulmonary tissue the treatment regime may be once or twice daily, preferably once daily, or once every 2, 3, 4, 5, 6, or 7 days.

Usually, in the above method, a single amino acid sequence, NANOBODY® ($V_{HH}$ sequence), compound or construct, or polypeptide of the invention will be used. It is however within the scope of the invention to use two or more amino acid sequences, NANOBODIES® ($V_{HH}$ sequences), compounds or constructs and/or polypeptides of the invention in combination.

The NANOBODIES® ($V_{HH}$ sequences), amino acid sequences, compounds or constructs and polypeptides of the invention may also be used in combination with one or more further pharmaceutically active compounds or principles, i.e. as a combined treatment regimen, which may or may not lead to a synergistic effect. Again, the clinician will be able to select such further compounds or principles, as well as a suitable combined treatment regimen, based on the factors cited above and his expert judgement.

In particular, the amino acid sequences, NANOBODIES® ($V_{HH}$ sequences), compounds or constructs, and polypeptides of the invention may be used in combination with other pharmaceutically active compounds or principles that are or can be used for the prevention and/or treatment of the diseases and disorders cited herein, as a result of which a synergistic effect may or may not be obtained. Examples of such compounds and principles, as well as routes, methods and pharmaceutical formulations or compositions for administering them will be clear to the clinician.

When two or more substances or principles are to be used as part of a combined treatment regimen, they can be administered via the same route of administration or via different routes of administration, at essentially the same time or at different times (e.g. essentially simultaneously, consecutively, or according to an alternating regime). When the substances or principles are to be administered simultaneously via the same route of administration, they may be administered as different pharmaceutical formulations or compositions or part of a combined pharmaceutical formulation or composition, as will be clear to the skilled person.

Also, when two or more active substances or principles are to be used as part of a combined treatment regimen, each of the substances or principles may be administered in the same amount and according to the same regimen as used when the compound or principle is used on its own, and such combined use may or may not lead to a synergistic effect. However, when the combined use of the two or more active substances or principles leads to a synergistic effect, it may also be possible to reduce the amount of one, more or all of the substances or principles to be administered, while still achieving the desired therapeutic action. This may for example be useful for avoiding, limiting or reducing any unwanted side-effects that are associated with the use of one or more of the substances or principles when they are used in their usual amounts, while still obtaining the desired pharmaceutical or therapeutic effect.

The effectiveness of the treatment regimen used according to the invention may be determined and/or followed in any manner known per se for the disease or disorder involved, as will be clear to the clinician. The clinician will also be able, where appropriate and on a case-by-case basis, to change or modify a particular treatment regimen, so as to achieve the desired therapeutic effect, to avoid, limit or reduce unwanted side-effects, and/or to achieve an appropriate balance between achieving the desired therapeutic effect on the one hand and avoiding, limiting or reducing undesired side effects on the other hand.

Generally, the treatment regimen will be followed until the desired therapeutic effect is achieved and/or for as long as the desired therapeutic effect is to be maintained. Again, this can be determined by the clinician.

In another aspect, the invention relates to the use of an amino acid sequence, NANOBODY® ($V_{HH}$ sequence), compound or construct, or polypeptide of the invention in the preparation of a pharmaceutical composition for prevention and/or treatment of at least one viral disease; and/or for use in one or more of the methods of treatment mentioned herein.

The subject to be treated may be any warm-blooded animal, but is in particular a mammal, and more in particular a human being. As will be clear to the skilled person, the subject to be treated will in particular be a person suffering from, or at risk of, the diseases and disorders mentioned herein.

The invention also relates to the use of an amino acid sequence, NANOBODY® ($V_{HH}$ sequence), compound or construct or polypeptide of the invention in the preparation of a pharmaceutical composition for the prevention and/or treatment of at least one disease or disorder that can be prevented and/or treated by administering an amino acid sequence, NANOBODY® ($V_{HH}$ sequence), compound or construct or polypeptide of the invention to a patient.

More in particular, the invention relates to the use of an amino acid sequence, NANOBODY® ($V_{HH}$ sequence), compound or construct or polypeptide of the invention in the preparation of a pharmaceutical composition for the prevention and/or treatment of viral diseases, and in particular for the prevention and treatment of one or more of the diseases and disorders listed herein.

Again, in such a pharmaceutical composition, the one or more amino acid sequences, NANOBODIES® ($V_{HH}$ sequences), compounds or constructs or polypeptides of the invention may also be suitably combined with one or more other active principles, such as those mentioned herein.

Finally, although the use of the NANOBODIES® ($V_{HH}$ sequences) of the invention (as defined herein) and of the polypeptides of the invention is much preferred, it will be clear that on the basis of the description herein, the skilled person will also be able to design and/or generate, in an analogous manner, other amino acid sequences and in particular (single) domain antibodies against an envelope protein of a virus, as well as polypeptides comprising such (single) domain antibodies.

For example, it will also be clear to the skilled person that it may be possible to "graft" one or more of the CDR's mentioned above for the NANOBODIES® ($V_{HH}$ sequences) of the invention onto such (single) domain antibodies or other protein scaffolds, including but not limited to human scaffolds or non-immunoglobulin scaffolds. Suitable scaffolds and techniques for such CDR grafting will be clear to the skilled person and are well known in the art, see for example those mentioned in WO 08/020079. For example, techniques known per se for grafting mouse or rat CDR's onto human frameworks and scaffolds can be used in an analogous manner to provide chimeric proteins comprising one or more of the CDR's of the NANOBODIES® ($V_{HH}$ sequences) of the invention and one or more human framework regions or sequences.

It should also be noted that, when the NANOBODIES® ($V_{HH}$ sequences) of the inventions contain one or more other CDR sequences than the preferred CDR sequences mentioned above, these CDR sequences can be obtained in any manner known per se, for example using one or more of the techniques described in WO 08/020079.

Further uses of the amino acid sequences, NANOBODIES® ($V_{HH}$ sequences), polypeptides, nucleic acids, genetic constructs and hosts and host cells of the invention will be clear to the skilled person based on the disclosure herein. For example, and without limitation, the amino acid sequences of the invention can be linked to a suitable carrier or solid support so as to provide a medium than can be used in a manner known per se to purify an envelope protein of a virus from compositions and preparations comprising the same. Derivatives of the amino acid sequences of the invention that comprise a suitable detectable label can also be used as markers to determine (qualitatively or quantitatively) the presence of an envelope protein of a virus in a composition or preparation or as a marker to selectively detect the presence of an envelope protein of a virus on the surface of a cell or tissue (for example, in combination with suitable cell sorting techniques).

The invention will now be further described by means of the following non-limiting preferred aspects, examples and figures:

Preferred Aspects:

Aspect A-1. Amino acid sequence that is directed against and/or that can specifically bind to an envelope protein of a virus.

Aspect A-2. Amino acid sequence according to aspect A-1, wherein said amino acid sequence modulates the interaction between said envelope protein and at least one binding partner.

Aspect A-3. Amino acid sequence according to aspects A-1 or A-2, wherein said amino acid sequence inhibits and/or prevents the interaction between said envelope protein and at least one binding partner.

Aspect A-4. Amino acid sequence according to any of the preceding aspects, wherein said amino acid sequence competes with said at least one binding partner for binding to said envelope protein.

Aspect A-5. Amino acid sequence according to aspect A-4, wherein said at least one binding partner is a viral receptor for an envelope protein of a virus.

Aspect A-6. Amino acid sequence according to aspect A-5, wherein said viral receptor is chosen from the group consisting of sialic acid, soluble (2,3)-sialic acid, (2,6)-sialic acid, CD4, CCR5, CXCR4, galactosylceramide, ACE2, HveA, CD155, ICAM-1, CAR, αv integrins, heparin sulphate proteoglycans, JAM-1, the Nicotinic Acetylcholine Receptor (AchR), and the Nueral Cell Adhesion Molecule (NCAM).

Aspect A-7. Amino acid sequence according to aspects A-5 or A-6, wherein said interaction between an envelope protein and a viral receptor is chosen from the group consisting of the interaction of HA of influenza A virus with sialic acid; (2,3) sialic acid; and/or (2,6) sialic acid; the interaction of gp120 of HIV-1 virus with CD4; CCR5; CXCR4; and/or galactosylceramide; the interaction of S1 of SARS coronavirus with ACE2; the interaction of gD; gB; and/or gC; the interaction of the heterodimer gH/gL of herpes simplex 1 virus with HveA; the interaction of VP1; VP2; and/or VP3 of poliovirus 1 with CD155; the interaction of VP1; VP2; and/or VP3 of rhinovirus 3 with ICAM-1; the interaction of adenovirus 2 fibre with CAR; the interaction of adenovirus 2 penton base with αv integrins; sialic acid; (2,3) sialic acid; (2,6) sialic acid; and/or heparin sulphate proteoglycans; the interaction of σ1 of reovirus 1 with JAM-1; sialic acid; (2,3) sialic acid; and/or (2,6) sialic acid; and the interaction of G-protein of rabies virus with the Nicotinic Acetylcholine Receptor (AchR); and/or the Nueral Cell Adhesion Molecule (NCAM).

Aspect A-8. Amino acid sequence according to aspect A-4, wherein said at least one binding partner is a monoclonal antibody or an antigen binding part thereof (such as a Fab, $Fab_2$, Fv, scFv, $V_H$, $V_{HH}$, $V_L$, NANOBODY® ($V_{HH}$ sequence), etc.) that is directed against and/or specifically binds to said envelope protein of a virus.

Aspect A-9. Amino acid sequence according to aspect A-8, wherein said monoclonal antibody or antigen binding part thereof is selected from Synagis®, 101F Fab, VN04-2, MAb C179 and MAb 8-2.

Aspect A-10. Amino acid sequence according to any of the preceding aspects, wherein said envelope protein is a viral-specific protein.

Aspect A-11. Amino acid sequence according to any of the preceding aspects, wherein said envelope protein is a membrane protein.

Aspect A-12. Amino acid sequence according to any of the preceding aspects, wherein said envelope protein is a non-glycosylated protein.

Aspect A-13. Amino acid sequence according to any of the preceding aspects, wherein said envelope protein is a glycoprotein.

Aspect A-14. Amino acid sequence according to any of the preceding aspects, wherein said envelope protein is a viral attachment protein.

Aspect A-15. Amino acid sequence according to aspect A-14, wherein said viral attachment protein is chosen from the group consisting of the G protein of RSV virus, the HA protein of influenza A virus, the gp120 protein of HIV-1 virus, the S1 protein of SARS Corona virus, the gD protein of Herpes simplex 1 virus, the VP1 and/or VP2 and/or VP3 proteins of Poliovirus 1, the VP1 and/or VP2 and/or VP3 proteins of Rhinovirus 3, fibre and/or penton base of Adenovirus 2 and σ1 of Reovirus 1.

Aspect A-16. Amino acid sequence according to any of aspects A-1 to A-13, wherein said envelope protein is a viral fusion protein.

Aspect A-17. Amino acid sequence according to aspect A-16, wherein said viral fusion protein is chosen from the group consisting of the F protein of RSV virus, the HA protein of Influenza A virus, the HEF protein of influenza C virus, the 5 F protein of Simian parainfluenza virus, the F protein of Human parainfluenza virus, the F protein of Newcastle disease virus, the F2 protein of measles, the F2 protein of Sendai virus, the gp2 protein of Ebola virus, the TM protein of Moloney murine leukemia virus, the gp41 protein of Human immunodeficiency virus 1, the gp41 protein of Simian immunodeficiency virus, the gp21 protein of Human T cell leukemia virus 1, the TM protein of Human syncytin-2, the TM protein of Visna virus, the S2 protein of Mouse hepatitis virus, the E2 protein of SARS corona virus, the E protein of Tick-borne encephalitis virus, the E2 protein of Dengue 2 and 3 virus, the E protein of Yellow Fever virus, the E protein of West Nile virus, the E1 protein of Semliki forest virus, the E1 protein of Sindbis virus, the G protein of Rabies virus, the G protein of Vesicular stomatitis virus and the gB protein of Herpes simplex virus.

Aspect A-18. Amino acid sequence according to any of the preceding aspects, wherein said envelope protein is a viral attachment protein and a viral fusion protein.

Aspect A-19. Amino acid sequence according to aspect A-18, wherein said viral attachment protein and viral fusion protein is chosen from the group consisting of the HA protein of influenza A virus, the E2 protein of SARS corona virus, the E protein of Tick-borne encephalitis virus, the E2 protein of Dengue 2 and 3 virus, the E protein of Yellow Fever virus, the E protein of West Nile virus, the E1 protein of Semliki forest virus, and the E1 protein of Sindbis virus.

Aspect A-20. Amino acid sequence according to aspects A-16 or A-18, wherein said viral fusion protein is characterized by a pre-fusion conformational state and/or an intermediate conformational state and/or a post-fusion conformational state.

Aspect A-21. Amino acid sequence according to aspect A-20, wherein said viral fusion protein is characterized by a pre-fusion conformational state, which is a fusion protein trimer.

Aspect A-22. Amino acid sequence according to aspect A-21, wherein said fusion protein trimer is a trimer of hairpins.

Aspect A-23. Amino acid sequence according to aspects A-21 or A-22, wherein said fusion protein trimer is a six-helix bundle.

Aspect A-24. Amino acid sequence according to any of aspects A-21 to A-23, wherein said fusion protein is chosen from the group consisting of Influenza A virus HA protein, Influenza C virus HEF protein, Simian parainfluenza virus 5 F protein, Human parainfluenza virus F protein, Newcastle disease virus F protein, Human respiratory syncytial virus F protein, Measles F2 protein, Sendai F2 protein, Ebola virus gp2 protein, Moloney murine leukemia virus TM protein, Human immunodeficiency virus 1 gp41 protein, Simian immunodeficiency virus gp41 protein, Human T cell leukemia virus 1 gp21 protein, Human syncytin-2 TM protein, Visna virus TM protein, Mouse hepatitis virus S2 protein, SARS corona virus E2 protein.

Aspect A-25. Amino acid sequence according to aspect A-24, wherein said fusion protein is Influenza A virus HA protein.

Aspect A-26. Amino acid sequence according to aspect A-24, wherein said fusion protein is Human respiratory syncytial virus F protein.

Aspect A-27. Amino acid sequence according to aspect A-20, wherein said fusion protein is characterized by a pre-fusion conformational state, which is a protein dimer.

Aspect A-28. Amino acid sequence according to aspect A-27, wherein said dimer is a fusion protein homodimer.

Aspect A-29. Amino acid sequence according to aspect A-27, wherein said dimer is a protein heterodimer.

Aspect A-30. Amino acid sequence according to aspect A-20, wherein said fusion protein is characterized by a pre-fusion conformational state, which is a fusion protein monomer.

Aspect A-31. Amino acid sequence according to any of aspects A-27 to A-30, wherein said fusion protein is chosen from the group consisting of Tick-borne encephalitis virus E protein, Dengue 2 and 3 virus E2 protein, yellow fever E protein, West Nile virus E protein, Semliki forest virus E1 protein and Sindbis E1 protein.

Aspect A-32. Amino acid sequence according to aspect A-20, wherein said fusion protein is characterized by a post-fusion conformational state, which is a fusion protein trimer.

Aspect A-33. Amino acid sequence according to aspect A-32, wherein said fusion protein trimer is a trimer of hairpins.

Aspect A-34. Amino acid sequence according to aspects A-32 or A-33, wherein said fusion protein trimer is a six-helix bundle.

Aspect A-35. Amino acid sequence according to aspect A-33, wherein said trimer of hairpins comprises an α-helical coiled coil.

Aspect A-36. Amino acid sequence according to any of aspects A-32 to A-35, wherein said fusion protein is chosen from the group consisting of Influenza A virus HA protein, Influenza C virus HEF protein, Simian parainfluenza virus 5 F protein, Human parainfluenza virus F protein, Newcastle disease virus F protein, Respiratory syncytial F protein, Measles F2 protein, Sendai F2 protein, Ebola virus gp2 protein, Moloney murine leukemia virus TM protein, Human immunodeficiency virus 1 gp41 protein, Simian immunodeficiency virus gp41 protein, Human T cell leukemia virus 1 gp21 protein, Human syncytin-2 TM protein, Visna virus TM protein, Mouse hepatitis virus S2 protein and SARS corona virus E2 protein.

Aspect A-37. Amino acid sequence according to aspect A-33, wherein said trimer of hairpins comprises β-structures.

Aspect A-38. Amino acid sequence according to any of aspects A-32 to A-34 and A-37, wherein said fusion protein is chosen from the group consisting of Tick-borne encephalitis virus E protein, Dengue 2 and 3 virus E2 protein, yellow fever E protein, West Nile virus E protein, Semliki forest virus E1 protein and Sindbis E1 protein.

Aspect A-39. Amino acid sequence according to any of aspects A-33, A-35 and A-37, wherein said trimer of hairpins comprises an α-helical coiled coil and β-structures.

Aspect A-40. Amino acid sequence according to aspect A-39, wherein said fusion protein is chosen from the group consisting of vesicular stomatitis virus G protein, Rabies virus G protein and Herpes simplex virus gB protein.

Aspect A-41. Amino acid sequence according to aspect A-40, wherein said fusion protein is Rabies virus G protein.

Aspect A-42. Amino acid sequence according to any of aspects A-20 to A-41, wherein said amino acid sequence is directed against and/or can specifically bind to the pre-fusion conformational state and/or the intermediate conformational state and/or the post-fusion conformational state of said fusion protein.

Aspect A-43. Amino acid sequence according to aspect A-42, wherein said amino acid sequence is directed against and/or can specifically bind to the pre-fusion conformational state and/or the intermediate conformational state of said fusion protein.

Aspect A-44. Amino acid sequence according to aspect A-42, wherein said amino acid sequence is directed against and/or can specifically bind to the intermediate conformational state and/or the post-fusion conformational state of said fusion protein.

Aspect A-45. Amino acid sequence according to aspect A-42, wherein said amino acid sequence is directed against and/or can specifically bind to the pre-fusion conformational state and/or the post-fusion conformational state of said fusion protein.

Aspect A-46. Amino acid sequence according to any of aspects A-21 to A-45, wherein said epitope is located in a cavity or cleft formed by said trimer according to claims A-21 to A-26 and A-32 to A-41 or formed by said dimer according to claims A-27 to A-31.

Aspect A-47. Amino acid sequence according to any of aspects A-21 to A-46, wherein said epitope is located in the stem region of said fusion protein.

Aspect A-48. Amino acid sequence according to aspect A-47, wherein said epitope that is located in the stem region of said fusion protein is chosen from the group consisting of an epitope that is located in the region comprising one or more of the amino acids 318 to 322 of the HA1 subunit of influenza HA and/or the region comprising one or more of the amino acids 47 to 58 of the HA2 subunit of influenza HA, an epitope that is located in the N-terminal region comprising one or more of the amino acids 1 to 38 of the HA2 subunit of influenza HA, an epitope that is located in the region comprising one or more of the amino acids 38 to 112 of the HA2 subunit of influenza HA, an epitope that is located in the region comprising one or more of the amino acids 125 to 175 of the HA2 subunit of influenza HA and an epitope that is located in the region comprising one or more of the amino acids 176 to 185 of the HA2 subunit of influenza HA.

Aspect A-49. Amino acid sequence according to any of aspects A-21 to A-46, wherein said epitope is located in the neck region of said fusion protein.

Aspect A-50. Amino acid sequence according to any of aspects A-21 to A-46, wherein said epitope is located in the globular head region of said fusion protein.

Aspect A-51. Amino acid sequence according to aspect A-50, wherein said globular head region comprises a β-barrel-type structure.

Aspect A-52. Amino acid sequence according to aspect A-50, wherein said globular head region comprises an immunoglobulin-type β-sandwich domain and a β-sheet domain.

Aspect A-53. Amino acid sequence according to any of aspects A-1 to A-52, wherein said epitope is chosen from the group consisting of an epitope that is located in the region comprising the A-antigenic site and/or amino acids 255 to 280 of the F-protein of RSV virus, an epitope that is located in the region comprising the Fla site and/or the region comprising amino acid 389 of the F-protein of RSV virus, an epitope that is located in the region comprising amino acids 422 to 438 of the F-protein of RSV virus, an epitope that is located in the region comprising the sialic acid binding site of the H5 HA envelope protein of influenza virus, an epitope that is located in the region comprising the Nicotinic Acetylcholine Receptor (AchR) and/or the Nueral Cell Adhesion Molecule (NCAM) binding site of the G-protein of rabies virus, an epitope that is located in the C-terminal region of a fusion protein, an epitope that is located in the N-terminal domain of a fusion protein, an epitope that is located in or comprises the fusion peptide of a fusion protein, an epitope that is located in the transmembrane domain of a fusion protein, an epitope that is located in a α-helical coiled-coil of a fusion protein, an epitope that is located in a β-structure of a fusion protein, an epitope that is located in Domain I of a fusion protein, an epitope that is located in Domain II of a fusion protein and an epitope that is located in Domain III of a fusion protein.

Aspect A-54. Amino acid sequence according to aspect A-53, wherein said epitope that is located in Domain II of a fusion protein is an epitope that is located in the fusion peptide of Domain II of a fusion protein.

Aspect A-55. Amino acid sequence according to aspect A-53, wherein said epitope that is located in Domain III of a fusion protein is chosen from the group consisting of an epitope that is located in the stem region at the C-terminus of Domain III of a fusion protein and an epitope that is located in the transmembrane anchor at the C-terminus of Domain III of a fusion protein.

Aspect A-56. Amino acid sequence according to any of aspects A-1 to A-55, wherein said virus is chosen from the group consisting of a DNA virus, an RNA virus and a Reverse Transcriptase (RT) virus.

Aspect A-57. Amino acid sequence according to aspect A-56, wherein said DNA virus is chosen from the group consisting of a ds DNA virus and a ssDNA virus.

Aspect A-58. Amino acid sequence according to aspect A-56, wherein said RNA virus is chosen from the group consisting of a dsRNA virus, a positive-sense ssRNA virus and a negative-sense ssRNA virus.

Aspect A-59. Amino acid sequence according to aspect A-56, wherein said Reverse Transcriptase (RT) virus is chosen from the group consisting of a dsDNA-RT virus and a ssRNA-RT virus.

Aspect A-60. Amino acid sequence according to any of aspects A-1 to A-55, wherein said virus belongs to a viral family chosen from the group consisting of Orthomyxoviridae, Paramyxoviridae, Filoviridae, Retroviridae, Coronaviridae, Togaviridae and Flaviviridae, Rhabdoviridae, Herpesviridae, Arenaviridae, Bornaviridae, Bunyaviridae, Hepadnaviridae and Poxviridae.

Aspect A-61. Amino acid sequence according to aspect A-60, wherein said virus belongs to a viral genus chosen from the group consisting of Alphaviruses and Flaviviruses.

Aspect A-62. Amino acid sequence according to any of aspects A-1 to A-61, wherein said amino acid sequence neutralizes said virus.

Aspect A-63. Amino acid sequence according to any of aspects A-1 to A-62, wherein said amino acid sequence modulates the infectivity of said virus.

Aspect A-64. Amino acid sequence according to aspect A-63, wherein said amino acid sequence inhibits and/or prevents the infectivity of said virus.

Aspect A-65. Amino acid sequence according to any of aspects A-63 or A-64, wherein said amino acid sequence neutralizes said virus and/or modulates, inhibits and/or prevents the infectivity of said virus in the pre-entry stage.

Aspect A-66. Amino acid sequence according to aspect A-65, wherein said amino acid sequence modulates, inhibits and/or prevents viral entry in a target host cell.

Aspect A-67. Amino acid sequence according to any of aspects A-1 to A-66, wherein said amino acid sequence induces virion aggregation of said virus.

Aspect A-68. Amino acid sequence according to any of aspects A-1 to A-67, wherein said amino acid sequence destabilizes the virion structure of said virus.

Aspect A-69. Amino acid sequence according to any of aspects A-1 to A-68, wherein said amino acid sequence inhibits virion attachment to a target host cell of said virus.

Aspect A-70. Amino acid sequence according to aspect A-69, wherein said amino acid sequence inhibits virion attachment to a target host cell of said virus by modulating the interaction between said envelope protein and a viral receptor.

Aspect A-71. Amino acid sequence according to aspects A-69 or A-70, wherein said amino acid sequence inhibits virion attachment to a target host cell of said virus by inhibiting and/or preventing the interaction between said envelope protein and a viral receptor.

Aspect A-72. Amino acid sequence according to aspects A-69 to A-71, wherein said amino acid sequence competes with said envelope protein for binding to a viral receptor.

Aspect A-73. Amino acid sequence according to any of aspects A-1 to A-72, wherein said amino acid sequence inhibits fusion of said virus with a target host cell of said virus.

Aspect A-74. Amino acid sequence according to aspect A-73, wherein fusion of said virus with a target host cell of said virus taking place at the target host cell membrane is inhibited.

Aspect A-75. Amino acid sequence according to aspect A-73, wherein fusion of said virus with a target host cell of said virus taking place within an endosomal or lysosomal compartment is inhibited.

Aspect A-76. Amino acid sequence according to any of aspects A-73 to A-75, wherein said amino acid sequence prevents said envelope protein of a virus from undergoing a conformational change.

Aspect A-77. Amino acid sequence according to any of aspects A-63 or A-64, wherein said amino acid sequence neutralizes said virus and/or modulates, inhibits and/or prevents the infectivity of said virus in the post-entry stage.

Aspect A-78. Amino acid sequence according to any of aspects A-1 to A-77, wherein said amino acid sequence modulates, inhibits and/or prevents viral replication in a target host cell.

Aspect A-79. Amino acid sequence according to any of aspects A-1 to A-78, wherein said amino acid sequence affects, inhibits and/or prevents transcription and/or translation of the viral genome.

Aspect A-80. Amino acid sequence according to any of aspects A-1 to A-79, wherein said amino acid sequence affects, inhibits and/or prevents viral packaging and/or the formation of functional virions.

Aspect A-81. Amino acid sequence according to any of aspects A-1 to A-80, wherein said amino acid sequence reduces, inhibits and/or prevents budding or release of nascent virions from a target host cell surface.

Aspect A-82. Amino acid sequence according to any of aspects A-1 to A-81, wherein said amino acid sequence is directed against and/or can specifically bind to at least two epitopes of at least one envelope protein of a virus.

Aspect A-83. Amino acid sequence according to aspect A-82, wherein said amino acid sequence is directed against and/or can specifically bind to at least two epitopes of one envelope protein of a virus.

Aspect A-84. Amino acid sequence according to any of aspects A-1 to A-82, wherein said amino acid sequence is directed against and/or can specifically bind to at least two epitopes of at least two envelope proteins of a virus.

Aspect A-85. Amino acid sequence according to any of aspects A-1 to A-82 and A-84, wherein said amino acid sequence is directed against and/or can specifically bind to three or more epitopes of an envelope protein of a virus.

Aspect A-86. Amino acid sequence according to aspect A-85, wherein said amino acid sequence is directed against and/or can specifically bind to three or more epitopes of at least two envelope proteins of a virus.

Aspect A-87. Amino acid sequence according to any of aspects A-82 to A-86, wherein said at least two or three or more epitopes are the same or are different.

Aspect A-88. Amino acid sequence according to any of aspects A-84 or A-86, wherein said at least two envelope proteins are the same or are different.

Aspect A-89. Amino acid sequence according to any of the preceding aspects, that is in essentially isolated form.

Aspect A-90. Amino acid sequence according to any of the preceding aspects, for administration to a subject, wherein said amino acid sequence does not naturally occur in said subject.

Aspect A-91. Amino acid sequence according to any of the preceding aspects, that can specifically bind to an envelope protein of a virus with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter.

Aspect A-92. Amino acid sequence according to any of the preceding aspects, that can specifically bind to an envelope protein of a virus with a rate of association ($k_{on}$-rate) of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$.

Aspect A-93. Amino acid sequence according to any of the preceding aspects, that can specifically bind to an envelope protein of a virus with a rate of dissociation ($k_{off}$ rate) between 1 $s^{-1}$ and $10^{-6}$ $s^{-1}$, preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Aspect A-94. Amino acid sequence according to any of the preceding aspects, that can specifically bind to an envelope protein of a virus with an affinity less than 500 nM, preferably less than 200 nM, more preferably less than 10 nM, such as less than 500 pM.

Aspect A-95. Amino acid sequence according to any of the preceding aspects, that is a naturally occurring amino acid sequence (from any suitable species) or a synthetic or semi-synthetic amino acid sequence.

Aspect A-96. Amino acid sequence according to any of the preceding aspects, that comprises an immunoglobulin fold or that under suitable conditions is capable of forming an immunoglobulin fold.

Aspect A-97. Amino acid sequence according to any of the preceding aspects, that essentially consists of 4 framework regions (FR1 to FR4 respectively) and 3 complementarity determining regions (CDR1 to CDR3 respectively).

Aspect A-98. Amino acid sequence according to any of the preceding aspects, that is an immunoglobulin sequence.

Aspect A-99. Amino acid sequence according to any of the preceding aspects, that is a naturally occurring immunoglobulin sequence (from any suitable species) or a synthetic or semi-synthetic immunoglobulin sequence.

Aspect A-100. Amino acid sequence according to any of the preceding aspects that is a humanized immunoglobulin sequence, a camelized immunoglobulin sequence or an immunoglobulin sequence that has been obtained by techniques such as affinity maturation.

Aspect A-101. Amino acid sequence according to any of the preceding aspects, that essentially consists of a light chain variable domain sequence (e.g. a $V_L$-sequence); or of a heavy chain variable domain sequence (e.g. a $V_H$-sequence).

Aspect A-102. Amino acid sequence according to any of the preceding aspects, that essentially consists of a heavy chain variable domain sequence that is derived from a conventional four-chain antibody or that essentially consist of a heavy chain variable domain sequence that is derived from heavy chain antibody.

Aspect A-103. Amino acid sequence according to any of the preceding aspects, that essentially consists of a domain antibody (or an amino acid sequence that is suitable for use as a domain antibody), of a single domain antibody (or an amino acid sequence that is suitable for use as a single domain antibody), of a "dAb" (or an amino acid sequence that is suitable for use as a dAb) or of a NANOBODY® ($V_{HH}$ sequence) (including but not limited to a $V_{HH}$ sequence).

Aspect A-104. Amino acid sequence according to any of the preceding aspects, that essentially consists of a NANOBODY® ($V_{HH}$ sequence).

Aspect A-105. Amino acid sequence according to any of the preceding aspects, that essentially consists of a NANOBODY® ($V_{HH}$ sequence) that a. has at least 80% amino acid identity with at least one of the amino acid sequences of SEQ ID NO's: 1 to 22, in which for the purposes of determining the degree of amino acid identity, the amino acid residues that form the CDR sequences are disregarded;

and in which:

b. preferably one or more of the amino acid residues at positions 11, 37, 44, 45, 47, 83, 84, 103, 104 and 108 according to the Kabat numbering are chosen from the Hallmark residues mentioned in Table B-2.

Aspect A-106. Amino acid sequence according to any of the preceding aspects, that essentially consists of a NANOBODY® ($V_{HH}$ sequence) that a. has at least 80% amino acid identity with at least one of the amino acid sequences of SEQ ID NO's: 126 to 407, 2431 to 2448, 2574 to 2581, 2682 to 2717 and 3064 to 3128, in which for the purposes of determining the degree of amino acid identity, the amino acid residues that form the CDR sequences are disregarded;

and in which:

b. preferably one or more of the amino acid residues at positions 11, 37, 44, 45, 47, 83, 84, 103, 104 and 108 according to the Kabat numbering are chosen from the Hallmark residues mentioned in Table B-2.

Aspect A-107. Amino acid sequence according to any of the preceding aspects, that essentially consists of a humanized NANOBODY® ($V_{HH}$ sequence).

Aspect A-108. Amino acid sequence according to aspect A-107, that essentially consists of a NANOBODY® ($V_{HH}$ sequence) that can bind (as further defined herein) to an envelope protein of a virus and which:

i) is a humanized variant of one of the amino acid sequences of SEQ ID NO's: 126 to 407, 2431 to 2448, 2574 to 2581, 2682 to 2717 and 3064 to 3128 (see Table A-1); and/or ii) has at least 80% amino acid identity with at least one of the amino acid sequences of SEQ ID NO's: 126 to 407, 2431 to 2448, 2574 to 2581, 2682 to 2717 and 3064 to 3128 (see Table A-1) and/or at least one of the amino acid sequences of SEQ ID NO's: 2999 to 3015 (see Table A-8), in which for the purposes of determining the degree of amino acid identity, the amino acid residues that form the CDR sequences are disregarded;

and in which:

iii) preferably one or more of the amino acid residues at positions 11, 37, 44, 45, 47, 83, 84, 103, 104 and 108 according to the Kabat numbering are chosen from the Hallmark residues mentioned in Table B-2 below.

Aspect A-109. Amino acid sequence according to any of the preceding aspects, that in addition to the at least one binding site for binding against an envelope protein of a virus, contains one or more further binding sites for binding against other antigens, proteins or targets.

Aspect B-1. Amino acid sequence directed against an envelope protein of a virus, that comprises one or more stretches of amino acid residues chosen from the group consisting of:

a. the amino acid sequences of SEQ ID NO's: 690 to 971, 2467 to 2484, 2590 to 2597, 2754 to 2789 and 3194 to 3258;

b. amino acid sequences that have at least 80% amino acid identity with at least one of the amino acid sequences of SEQ ID NO's: 690 to 971, 2467 to 2484, 2590 to 2597, 2754 to 2789 and 3194 to 3258;

c. amino acid sequences that have 3, 2, or 1 amino acid difference with at least one of the amino acid sequences of SEQ ID NO's: 690 to 971, 2467 to 2484, 2590 to 2597, 2754 to 2789 and 3194 to 3258;

d. the amino acid sequences of SEQ ID NO's: 1254 to 1535, 2503 to 2520, 2606 to 2613, 2826 to 2861 and 3324 to 3388;

e. amino acid sequences that have at least 80% amino acid identity with at least one of the amino acid sequences of SEQ ID NO's: 1254 to 1535, 2503 to 2520, 2606 to 2613, 2826 to 2861 and 3324 to 3388;

f. amino acid sequences that have 3, 2, or 1 amino acid difference with at least one of the amino acid sequences of SEQ ID NO's: 1254 to 1535, 2503 to 2520, 2606 to 2613, 2826 to 2861 and 3324 to 3388;

g. the amino acid sequences of SEQ ID NO's: 1818 to 2099, 2539 to 2556, 2622 to 2629, 2898 to 2933 and 3454 to 3518;

h. amino acid sequences that have at least 80% amino acid identity with at least one of the amino acid sequences of SEQ ID NO's: 1818 to 2099, 2539 to 2556, 2622 to 2629, 2898 to 2933 and 3454 to 3518;

i. amino acid sequences that have 3, 2, or 1 amino acid difference with at least one of the amino acid sequences of SEQ ID NO's: 1818 to 2099, 2539 to 2556, 2622 to 2629, 2898 to 2933 and 3454 to 3518;

or any suitable combination thereof.

Such an amino acid sequence may in particular be an amino acid sequence according to any of the aspects A-1 to A-109.

Aspect B-2. Amino acid sequence according to aspect B-1, in which at least one of said stretches of amino acid residues forms part of the antigen binding site for binding against an envelope protein of a virus.

Aspect B-3. Amino acid sequence directed against and/or that can specifically bind an envelope protein of a virus, that comprises two or more stretches of amino acid residues chosen from the group consisting of:

a. the amino acid sequences of SEQ ID NO's: 690 to 971, 2467 to 2484, 2590 to 2597, 2754 to 2789 and 3194 to 3258;

b. amino acid sequences that have at least 80% amino acid identity with at least one of the amino acid sequences of SEQ ID NO's: 690 to 971, 2467 to 2484, 2590 to 2597, 2754 to 2789 and 3194 to 3258;

c. amino acid sequences that have 3, 2, or 1 amino acid difference with at least one of the amino acid sequences of SEQ ID NO's: 690 to 971, 2467 to 2484, 2590 to 2597, 2754 to 2789 and 3194 to 3258;

d. the amino acid sequences of SEQ ID NO's: 1254 to 1535, 2503 to 2520, 2606 to 2613, 2826 to 2861 and 3324 to 3388;

e. amino acid sequences that have at least 80% amino acid identity with at least one of the amino acid sequences of SEQ ID NO's: 1254 to 1535, 2503 to 2520, 2606 to 2613, 2826 to 2861 and 3324 to 3388;

f. amino acid sequences that have 3, 2, or 1 amino acid difference with at least one of the amino acid sequences of SEQ ID NO's: 1254 to 1535, 2503 to 2520, 2606 to 2613, 2826 to 2861 and 3324 to 3388;

g. the amino acid sequences of SEQ ID NO's: 1818 to 2099, 2539 to 2556, 2622 to 2629, 2898 to 2933 and 3454 to 3518;

h. amino acid sequences that have at least 80% amino acid identity with at least one of the amino acid sequences of SEQ ID NO's: 1818 to 2099, 2539 to 2556, 2622 to 2629, 2898 to 2933 and 3454 to 3518;

i. amino acid sequences that have 3, 2, or 1 amino acid difference with at least one of the amino acid sequences of SEQ ID NO's: 1818 to 2099, 2539 to 2556, 2622 to 2629, 2898 to 2933 and 3454 to 3518;

such that (i) when the first stretch of amino acid residues corresponds to one of the amino acid sequences according to a), b) or c), the second stretch of amino acid residues corresponds to one of the amino acid sequences according to d), e), f), g), h) or i); (ii) when the first stretch of amino acid residues corresponds to one of the amino acid sequences according to d), e) or f), the second stretch of amino acid residues corresponds to one of the amino acid sequences according to a), b), c), g), h) or i); or (iii) when the first stretch of amino acid residues corresponds to one of the amino acid sequences according to g), h) or i), the second stretch of amino acid residues corresponds to one of the amino acid sequences according to a), b), c), d), e) or f).

Such an amino acid sequence may in particular be an amino acid sequence according to any of the aspects A-1 to A-109, B-1 or B-2.

Aspect B-4. Amino acid sequence according to aspect B-3, in which the at least two stretches of amino acid residues forms part of the antigen binding site for binding against an envelope protein of a virus.

Aspect B-5. Amino acid sequence that is directed against and/or that specifically binds an envelope protein of a virus, that comprises three or more stretches of amino acid residues, in which the first stretch of amino acid residues is chosen from the group consisting of:

a. the amino acid sequences of SEQ ID NO's: 690 to 971, 2467 to 2484, 2590 to 2597, 2754 to 2789 and 3194 to 3258;
b. amino acid sequences that have at least 80% amino acid identity with at least one of the amino acid sequences of SEQ ID NO's: 690 to 971, 2467 to 2484, 2590 to 2597, 2754 to 2789 and 3194 to 3258;
c. amino acid sequences that have 3, 2, or 1 amino acid difference with at least one of the amino acid sequences of SEQ ID NO's: 690 to 971, 2467 to 2484, 2590 to 2597, 2754 to 2789 and 3194 to 3258;

the second stretch of amino acid residues is chosen from the group consisting of:

d. the amino acid sequences of SEQ ID NO's: 1254 to 1535, 2503 to 2520, 2606 to 2613, 2826 to 2861 and 3324 to 3388;
e. amino acid sequences that have at least 80% amino acid identity with at least one of the amino acid sequences of SEQ ID NO's: 1254 to 1535, 2503 to 2520, 2606 to 2613, 2826 to 2861 and 3324 to 3388;
f. amino acid sequences that have 3, 2, or 1 amino acid difference with at least one of the amino acid sequences of SEQ ID NO's: 1254 to 1535, 2503 to 2520, 2606 to 2613, 2826 to 2861 and 3324 to 3388;

and the third stretch of amino acid residues is chosen from the group consisting of:

g. the amino acid sequences of SEQ ID NO's: 1818 to 2099, 2539 to 2556, 2622 to 2629, 2898 to 2933 and 3454 to 3518;
h. amino acid sequences that have at least 80% amino acid identity with at least one of the amino acid sequences of SEQ ID NO's: 1818 to 2099, 2539 to 2556, 2622 to 2629, 2898 to 2933 and 3454 to 3518;
i. amino acid sequences that have 3, 2, or 1 amino acid difference with at least one of the amino acid sequences of SEQ ID NO's: 1818 to 2099, 2539 to 2556, 2622 to 2629, 2898 to 2933 and 3454 to 3518.

Such an amino acid sequence may in particular be an amino acid sequence according to any of the aspects A-1 to A-109 and/or B-1 to B-4.

Aspect B-6. Amino acid sequence according to aspect B-5, in which the at least three stretches of amino acid residues forms part of the antigen binding site for binding against an envelope protein of a virus.

Aspect B-7. Amino acid sequence that is directed against and/or that can specifically bind an envelope protein of a virus, in which the CDR sequences of said amino acid sequence have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 126 to 407, 2431 to 2448, 2574 to 2581, 2682 to 2717 and 3064 to 3128. Such an amino acid sequence may in particular be an amino acid sequence according to any of the aspects A-1 to A-109 and/or B-1 to B-6.

Aspect C-1: Amino acid sequence directed against an envelope protein of a virus that cross-blocks the binding of at least one of the amino acid sequences of SEQ ID NO's: 126 to 407, 2431 to 2448, 2574 to 2581, 2682 to 2717 and 3064 to 3128 to said envelope protein of a virus. Such an amino acid sequence may in particular be an amino acid sequence according to any of the aspects A-1 to A-109 and/or according to aspects B-1 to B-7. Also, preferably, such an amino acid sequence is able to specifically bind to an envelope protein of a virus.

Aspect C-2: Amino acid sequence directed against an envelope protein of a virus that is cross-blocked from binding to said envelope protein of a virus by at least one of the amino acid sequences of SEQ ID NO's: 126 to 407, 2431 to 2448, 2574 to 2581, 2682 to 2717 and 3064 to 3128. Such an amino acid sequence may in particular be an amino acid sequence according to any of the aspects A-1 to A-109 and/or according to aspects B-1 to B-7. Also, preferably, such an amino acid sequence is able to specifically bind to an envelope protein of a virus.

Aspect C-3: Amino acid sequence according to any of aspects C-1 or C-2 wherein the ability of said amino acid sequence to cross-block or to be cross-blocked is detected in a Biacore assay.

Aspect C-4: Amino acid sequence according to any of aspects C-1 or C-2 wherein the ability of said amino acid sequence to cross-block or to be cross-blocked is detected in an ELISA assay.

Aspect B-8: Amino acid sequence that is directed against and/or that can specifically bind at least one epitope of the F-protein of human RSV virus, that comprises one or more stretches of amino acid residues chosen from the group consisting of:

a. the amino acid sequences of SEQ ID NO's: 722 to 800, 812 to 971, 2484 and 2590 to 2597;
b. amino acid sequences that have at least 80% amino acid identity with at least one of the amino acid sequences of SEQ ID NO's: 722 to 800, 812 to 971, 2484 and 2590 to 2597;
c. amino acid sequences that have 3, 2, or 1 amino acid difference with at least one of the amino acid sequences of SEQ ID NO's: 722 to 800, 812 to 971, 2484 and 2590 to 2597;
d. the amino acid sequences of SEQ ID NO's: 1286 to 1364, 1376 to 1535, 2520 and 2606 to 2613;
e. amino acid sequences that have at least 80% amino acid identity with at least one of the amino acid sequences of SEQ ID NO's: 1286 to 1364, 1376 to 1535, 2520 and 2606 to 2613;
f. amino acid sequences that have 3, 2, or 1 amino acid difference with at least one of the amino acid sequences of SEQ ID NO's: 1286 to 1364, 1376 to 1535, 2520 and 2606 to 2613;
g. the amino acid sequences of SEQ ID NO's: 1850 to 1928, 1940 to 2099, 2556 and 2622 to 2629;
h. amino acid sequences that have at least 80% amino acid identity with at least one of the amino acid sequences of SEQ ID NO's: 1850 to 1928, 1940 to 2099, 2556 and 2622 to 2629;
i. amino acid sequences that have 3, 2, or 1 amino acid difference with at least one of the amino acid sequences of SEQ ID NO's: 1850 to 1928, 1940 to 2099, 2556 and 2622 to 2629;

or any suitable combination thereof.

Such an amino acid sequence may in particular be an amino acid sequence according to any of the aspects A-1 to A-109.

Aspect B-9: Amino acid sequence according to aspect B-8, in which at least one of said stretches of amino acid residues forms part of the antigen binding site for binding against at least one epitope of the F-protein of human RSV virus.

Aspect B-10: Amino acid sequence that is directed against and/or that can specifically bind at least one epitope of the F-protein of human RSV virus, that comprises two or more stretches of amino acid residues chosen from the group consisting of:

a. the amino acid sequences of SEQ ID NO's: 722 to 800, 812 to 971, 2484 and 2590 to 2597;
b. amino acid sequences that have at least 80% amino acid identity with at least one of the amino acid sequences of SEQ ID NO's: 722 to 800, 812 to 971, 2484 and 2590 to 2597;
c. amino acid sequences that have 3, 2, or 1 amino acid difference with at least one of the amino acid sequences of SEQ ID NO's: 722 to 800, 812 to 971, 2484 and 2590 to 2597;
d. the amino acid sequences of SEQ ID NO's: 1286 to 1364, 1376 to 1535, 2520 and 2606 to 2613;
e. amino acid sequences that have at least 80% amino acid identity with at least one of the amino acid sequences of SEQ ID NO's: 1286 to 1364, 1376 to 1535, 2520 and 2606 to 2613;
f. amino acid sequences that have 3, 2, or 1 amino acid difference with at least one of the amino acid sequences of SEQ ID NO's: 1286 to 1364, 1376 to 1535, 2520 and 2606 to 2613;
g. the amino acid sequences of SEQ ID NO's: 1850 to 1928, 1940 to 2099, 2556 and 2622 to 2629;
h. amino acid sequences that have at least 80% amino acid identity with at least one of the amino acid sequences of SEQ ID NO's: 1850 to 1928, 1940 to 2099, 2556 and 2622 to 2629;
i. amino acid sequences that have 3, 2, or 1 amino acid difference with at least one of the amino acid sequences of SEQ ID NO's: 1850 to 1928, 1940 to 2099, 2556 and 2622 to 2629;

such that (i) when the first stretch of amino acid residues corresponds to one of the amino acid sequences according to a), b) or c), the second stretch of amino acid residues corresponds to one of the amino acid sequences according to d), e), f), g), h) or i); (ii) when the first stretch of amino acid residues corresponds to one of the amino acid sequences according to d), e) or f), the second stretch of amino acid residues corresponds to one of the amino acid sequences according to a), b), c), g), h) or i); or (iii) when the first stretch of amino acid residues corresponds to one of the amino acid sequences according to g), h) or i), the second stretch of amino acid residues corresponds to one of the amino acid sequences according to a), b), c), d), e) or f).

Such an amino acid sequence may in particular be an amino acid sequence according to any of the aspects A-1 to A-109, B-8 or B-9.

Aspect B-11: Amino acid sequence according to aspect B-10, in which the at least two stretches of amino acid residues forms part of the antigen binding site for binding against at least one epitope of the F-protein of human RSV virus.

Aspect B-12: Amino acid sequence that is directed against and/or that can specifically bind at least one epitope of the F-protein of human RSV virus, that comprises three or more stretches of amino acid residues, in which the first stretch of amino acid residues is chosen from the group consisting of:

a. the amino acid sequences of SEQ ID NO's: 722 to 800, 812 to 971, 2484 and 2590 to 2597;
b. amino acid sequences that have at least 80% amino acid identity with at least one of the amino acid sequences of SEQ ID NO's: 722 to 800, 812 to 971, 2484 and 2590 to 2597;
c. amino acid sequences that have 3, 2, or 1 amino acid difference with at least one of the amino acid sequences of SEQ ID NO's: 722 to 800, 812 to 971, 2484 and 2590 to 2597;

the second stretch of amino acid residues is chosen from the group consisting of:

d. the amino acid sequences of SEQ ID NO's: 1286 to 1364, 1376 to 1535, 2520 and 2606 to 2613;
e. amino acid sequences that have at least 80% amino acid identity with at least one of the amino acid sequences of SEQ ID NO's: 1286 to 1364, 1376 to 1535, 2520 and 2606 to 2613;
f. amino acid sequences that have 3, 2, or 1 amino acid difference with at least one of the amino acid sequences of SEQ ID NO's: 1286 to 1364, 1376 to 1535, 2520 and 2606 to 2613;

and the third stretch of amino acid residues is chosen from the group consisting of:

g. the amino acid sequences of SEQ ID NO's: 1850 to 1928, 1940 to 2099, 2556 and 2622 to 2629;
h. amino acid sequences that have at least 80% amino acid identity with at least one of the amino acid sequences of SEQ ID NO's: 1850 to 1928, 1940 to 2099, 2556 and 2622 to 2629;
i. amino acid sequences that have 3, 2, or 1 amino acid difference with at least one of the amino acid sequences of SEQ ID NO's: 1850 to 1928, 1940 to 2099, 2556 and 2622 to 2629.

Such an amino acid sequence may in particular be an amino acid sequence according to any of the aspects A-1 to A-109 and/or B-8 to B-11.

Aspect B-13: Amino acid sequence according to aspect B-12, in which the at least three stretches of amino acid residues forms part of the antigen binding site for binding to at least one epitope of the F-protein of human RSV virus.

Aspect B-14: Amino acid sequence that is directed against and/or that can specifically bind at least one epitope of the F-protein of human RSV virus, in which the CDR sequences of said amino acid sequence have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 158 to 236, 248 to 407, 2448 and 2574 to 2581. Such an amino acid sequence may in particular be an amino acid sequence according to any of the aspects A-1 to A-109 and/or B-8 to B-13.

Aspect C-5: Amino acid sequence directed against at least one epitope of the F-protein of human RSV virus that cross-blocks the binding of at least one of the amino acid sequences of SEQ ID NO's: 158 to 236, 248 to 407, 2448 and 2574 to 2581 to said at least one epitope of the F-protein of human RSV virus. Such an amino acid sequence may in particular be an amino acid sequence according to any of the aspects A-1 to A-109 and/or according to aspects B-8 to B-14. Also, preferably, such an amino acid sequence is able to specifically bind to the F-protein of human RSV virus.

Aspect C-6: Amino acid sequence directed against at least one epitope of the F-protein of human RSV virus that is cross-blocked from binding to said at least one epitope of the F-protein of human RSV virus by at least one of the amino acid sequences of SEQ ID NO's: 158 to 236, 248 to 407, 2448 and 2574 to 2581. Such an amino acid sequence may in particular be an amino acid sequence according to any of the aspects A-1 to A-109 and/or according to aspects B-8 to B-14. Also, preferably, such an amino acid sequence is able to specifically bind to the F-protein of human RSV virus.

Aspect C-7: Amino acid sequence according to any of aspects C-5 or C-6 wherein the ability of said amino acid sequence to cross-block or to be cross-blocked is detected in a Biacore assay.

Aspect C-8: Amino acid sequence according to any of aspects C-5 or C-6 wherein the ability of said amino acid sequence to cross-block or to be cross-blocked is detected in an ELISA assay.

Aspect B-15: Amino acid sequence that is directed against and/or that can specifically bind at least one epitope of the hemagglutinin HA5 protein of influenza virus, that comprises one or more stretches of amino acid residues chosen from the group consisting of:

a. the amino acid sequences of SEQ ID NO's: 690 to 721, 2467 to 2483, 2754 to 2755 and 3194 to 3258;
b. amino acid sequences that have at least 80% amino acid identity with at least one of the amino acid sequences of SEQ ID NO's: 690 to 721, 2467 to 2483, 2754 to 2755 and 3194 to 3258;
c. amino acid sequences that have 3, 2, or 1 amino acid difference with at least one of the amino acid sequences of SEQ ID NO's: 690 to 721, 2467 to 2483, 2754 to 2755 and 3194 to 3258;
d. the amino acid sequences of SEQ ID NO's: 1254 to 1285, 2503 to 2519, 2826 to 2827 and 3324 to 3388;
e. amino acid sequences that have at least 80% amino acid identity with at least one of the amino acid sequences of SEQ ID NO's: 1254 to 1285, 2503 to 2519, 2826 to 2827 and 3324 to 3388;
f. amino acid sequences that have 3, 2, or 1 amino acid difference with at least one of the amino acid sequences of SEQ ID NO's: 1254 to 1285, 2503 to 2519, 2826 to 2827 and 3324 to 3388;
g. the amino acid sequences of SEQ ID NO's: 1818 to 1849, 2539 to 2555, 2898 to 2899 and 3454 to 3518;
h. amino acid sequences that have at least 80% amino acid identity with at least one of the amino acid sequences of SEQ ID NO's: 1818 to 1849, 2539 to 2555, 2898 to 2899 and 3454 to 3518;
i. amino acid sequences that have 3, 2, or 1 amino acid difference with at least one of the amino acid sequences of SEQ ID NO's: 1818 to 1849, 2539 to 2555, 2898 to 2899 and 3454 to 3518;

or any suitable combination thereof.

Such an amino acid sequence may in particular be an amino acid sequence according to any of the aspects A-1 to A-109.

Aspect B-16: Amino acid sequence according to aspect B-15, in which at least one of said stretches of amino acid residues forms part of the antigen binding site for binding against at least one epitope of the hemagglutinin HA5 protein of influenza virus.

Aspect B-17: Amino acid sequence that is directed against and/or that can specifically bind at least one epitope of the hemagglutinin HA5 protein of influenza virus, that comprises two or more stretches of amino acid residues chosen from the group consisting of:

a. the amino acid sequences of SEQ ID NO's: 690 to 721, 2467 to 2483, 2754 to 2755 and 3194 to 3258;
b. amino acid sequences that have at least 80% amino acid identity with at least one of the amino acid sequences of SEQ ID NO's: 690 to 721, 2467 to 2483, 2754 to 2755 and 3194 to 3258;
c. amino acid sequences that have 3, 2, or 1 amino acid difference with at least one of the amino acid sequences of SEQ ID NO's: 690 to 721, 2467 to 2483, 2754 to 2755 and 3194 to 3258;
d. the amino acid sequences of SEQ ID NO's: 1254 to 1285, 2503 to 2519, 2826 to 2827 and 3324 to 3388;
e. amino acid sequences that have at least 80% amino acid identity with at least one of the amino acid sequences of SEQ ID NO's: 1254 to 1285, 2503 to 2519, 2826 to 2827 and 3324 to 3388;
f. amino acid sequences that have 3, 2, or 1 amino acid difference with at least one of the amino acid sequences of SEQ ID NO's: 1254 to 1285, 2503 to 2519, 2826 to 2827 and 3324 to 3388;
g. the amino acid sequences of SEQ ID NO's: 1818 to 1849, 2539 to 2555, 2898 to 2899 and 3454 to 3518;
h. amino acid sequences that have at least 80% amino acid identity with at least one of the amino acid sequences of SEQ ID NO's: 1818 to 1849, 2539 to 2555, 2898 to 2899 and 3454 to 3518;
i. amino acid sequences that have 3, 2, or 1 amino acid difference with at least one of the amino acid sequences of SEQ ID NO's: 1818 to 1849, 2539 to 2555, 2898 to 2899 and 3454 to 3518;

such that (i) when the first stretch of amino acid residues corresponds to one of the amino acid sequences according to a), b) or c), the second stretch of amino acid residues corresponds to one of the amino acid sequences according to d), e), f), g), h) or i); (ii) when the first stretch of amino acid residues corresponds to one of the amino acid sequences according to d), e) or f), the second stretch of amino acid residues corresponds to one of the amino acid sequences according to a), b), c), g), h) or i); or (iii) when the first stretch of amino acid residues corresponds to one of the amino acid sequences according to g), h) or i), the second stretch of amino acid residues corresponds to one of the amino acid sequences according to a), b), c), d), e) or f).

Such an amino acid sequence may in particular be an amino acid sequence according to any of the aspects A-1 to A-109, B-15 or B-16.

Aspect B-18: Amino acid sequence according to aspect B-17, in which the at least two stretches of amino acid residues forms part of the antigen binding site for binding against at least one epitope of the hemagglutinin HA5 protein of influenza virus.

Aspect B-19: Amino acid sequence that is directed against and/or that can specifically bind at least one epitope of the hemagglutinin HA5 protein of influenza virus, that comprises three or more stretches of amino acid residues, in which the first stretch of amino acid residues is chosen from the group consisting of:

a. the amino acid sequences of SEQ ID NO's: 690 to 721, 2467 to 2483, 2754 to 2755 and 3194 to 3258;
b. amino acid sequences that have at least 80% amino acid identity with at least one of the amino acid sequences of SEQ ID NO's: 690 to 721, 2467 to 2483, 2754 to 2755 and 3194 to 3258;
c. amino acid sequences that have 3, 2, or 1 amino acid difference with at least one of the amino acid sequences of SEQ ID NO's: 690 to 721, 2467 to 2483, 2754 to 2755 and 3194 to 3258;

the second stretch of amino acid residues is chosen from the group consisting of:
- d. the amino acid sequences of SEQ ID NO's: 1254 to 1285, 2503 to 2519, 2826 to 2827 and 3324 to 3388;
- e. amino acid sequences that have at least 80% amino acid identity with at least one of the amino acid sequences of SEQ ID NO's: 1254 to 1285, 2503 to 2519, 2826 to 2827 and 3324 to 3388;
- f. amino acid sequences that have 3, 2, or 1 amino acid difference with at least one of the amino acid sequences of SEQ ID NO's: 1254 to 1285, 2503 to 2519, 2826 to 2827 and 3324 to 3388;

and the third stretch of amino acid residues is chosen from the group consisting of:
- g. the amino acid sequences of SEQ ID NO's: 1818 to 1849, 2539 to 2555, 2898 to 2899 and 3454 to 3518;
- h. amino acid sequences that have at least 80% amino acid identity with at least one of the amino acid sequences of SEQ ID NO's: 1818 to 1849, 2539 to 2555, 2898 to 2899 and 3454 to 3518;
- i. amino acid sequences that have 3, 2, or 1 amino acid difference with at least one of the amino acid sequences of SEQ ID NO's: 1818 to 1849, 2539 to 2555, 2898 to 2899 and 3454 to 3518.

Such an amino acid sequence may in particular be an amino acid sequence according to any of the aspects A-1 to A-109 and/or B-15 to B-18.

Aspect B-20: Amino acid sequence according to aspect B-19, in which the at least three stretches of amino acid residues forms part of the antigen binding site for binding against at least one epitope of the hemagglutinin HA5 protein of influenza virus.

Aspect B-21: Amino acid sequence that is directed against and/or that can specifically bind at least one epitope of the hemagglutinin HA5 protein of influenza virus, in which the CDR sequences of said amino acid sequence have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 126 to 157, 2431 to 2447, 2682 to 2683 and 3064 to 3128. Such an amino acid sequence may in particular be an amino acid sequence according to any of the aspects A-1 to A-109 and/or B-15 to B-20.

Aspect C-9: Amino acid sequence directed against at least one epitope of the hemagglutinin HA5 protein of influenza virus that cross-blocks the binding of at least one of the amino acid sequences of SEQ ID NO's: 126 to 157, 2431 to 2447, 2682 to 2683 and 3064 to 3128 to said at least one epitope of the hemagglutinin HA5 protein of influenza virus. Such an amino acid sequence may in particular be an amino acid sequence according to any of the aspects A-1 to A-109 and/or according to aspects B-15 to B-21. Also, preferably, such an amino acid sequence is able to specifically bind to the hemagglutinin HA5 protein of influenza virus.

Aspect C-10: Amino acid sequence directed against an epitope of the hemagglutinin HA5 protein of influenza virus that is cross-blocked from binding to said at least one epitope of the hemagglutinin HA5 protein of influenza virus by at least one of the amino acid sequences of SEQ ID NO's: 126 to 157, 2431 to 2447, 2682 to 2683 and 3064 to 3128. Such an amino acid sequence may in particular be an amino acid sequence according to any of the aspects A-1 to A-109 and/or according to aspects B-15 to B-21. Also, preferably, such an amino acid sequence is able to specifically bind to the hemagglutinin HA5 protein of influenza virus.

Aspect C-11: Amino acid sequence according to any of aspects C-9 or C-10, wherein the ability of said amino acid sequence to cross-block or to be cross-blocked is detected in a Biacore assay.

Aspect C-12: Amino acid sequence according to any of aspects C-9 or C-10 wherein the ability of said amino acid sequence to cross-block or to be cross-blocked is detected in an ELISA assay.

Aspect B-22: Amino acid sequence that is directed against and/or that can specifically bind at least one epitope of the G-protein of rabies virus, that comprises one or more stretches of amino acid residues chosen from the group consisting of:
- a) the amino acid sequences of SEQ ID NO's: 801 to 811 and 2756 to 2789;
- b) amino acid sequences that have at least 80% amino acid identity with at least one of the amino acid sequences of SEQ ID NO's: 801 to 811 and 2756 to 2789;
- c) amino acid sequences that have 3, 2, or 1 amino acid difference with at least one of the amino acid sequences of SEQ ID NO's: 801 to 811 and 2756 to 2789;
- d) the amino acid sequences of SEQ ID NO's: 1365 to 1375 and 2828 to 2861;
- e) amino acid sequences that have at least 80% amino acid identity with at least one of the amino acid sequences of SEQ ID NO's: 1365 to 1375 and 2828 to 2861;
- f) amino acid sequences that have 3, 2, or 1 amino acid difference with at least one of the amino acid sequences of SEQ ID NO's: 1365 to 1375 and 2828 to 2861;
- g) the amino acid sequences of SEQ ID NO's: 1929 to 1939 and 2900 to 2933;
- h) amino acid sequences that have at least 80% amino acid identity with at least one of the amino acid sequences of SEQ ID NO's: 1929 to 1939 and 2900 to 2933;
- i) amino acid sequences that have 3, 2, or 1 amino acid difference with at least one of the amino acid sequences of SEQ ID NO's: 1929 to 1939 and 2900 to 2933;

or any suitable combination thereof.

Such an amino acid sequence may in particular be an amino acid sequence according to any of the aspects A-1 to A-109.

Aspect B-23: Amino acid sequence according to aspect B-22, in which at least one of said stretches of amino acid residues forms part of the antigen binding site for binding against at least one epitope of the G-protein of rabies virus.

Aspect B-24: Amino acid sequence that is directed against and/or that can specifically bind at least one epitope of the G-protein of rabies virus, that comprises two or more stretches of amino acid residues chosen from the group consisting of:
- a) the amino acid sequences of SEQ ID NO's: 801 to 811 and 2756 to 2789;
- b) amino acid sequences that have at least 80% amino acid identity with at least one of the amino acid sequences of SEQ ID NO's: 801 to 811 and 2756 to 2789;
- c) amino acid sequences that have 3, 2, or 1 amino acid difference with at least one of the amino acid sequences of SEQ ID NO's: 801 to 811 and 2756 to 2789;
- d) the amino acid sequences of SEQ ID NO's: 1365 to 1375 and 2828 to 2861;
- e) amino acid sequences that have at least 80% amino acid identity with at least one of the amino acid sequences of SEQ ID NO's: 1365 to 1375 and 2828 to 2861;

f) amino acid sequences that have 3, 2, or 1 amino acid difference with at least one of the amino acid sequences of SEQ ID NO's: 1365 to 1375 and 2828 to 2861;

g) the amino acid sequences of SEQ ID NO's: 1929 to 1939 and 2900 to 2933;

h) amino acid sequences that have at least 80% amino acid identity with at least one of the amino acid sequences of SEQ ID NO's: 1929 to 1939 and 2900 to 2933;

i) amino acid sequences that have 3, 2, or 1 amino acid difference with at least one of the amino acid sequences of SEQ ID NO's: 1929 to 1939 and 2900 to 2933;

such that (i) when the first stretch of amino acid residues corresponds to one of the amino acid sequences according to a), b) or c), the second stretch of amino acid residues corresponds to one of the amino acid sequences according to d), e), f), g), h) or i); (ii) when the first stretch of amino acid residues corresponds to one of the amino acid sequences according to d), e) or f), the second stretch of amino acid residues corresponds to one of the amino acid sequences according to a), b), c), g), h) or i); or (iii) when the first stretch of amino acid residues corresponds to one of the amino acid sequences according to g), h) or i), the second stretch of amino acid residues corresponds to one of the amino acid sequences according to a), b), c), d), e) or f).

Such an amino acid sequence may in particular be an amino acid sequence according to any of the aspects A-1 to A-109, B-22 or B-23.

Aspect B-25: Amino acid sequence according to aspect B-24, in which the at least two stretches of amino acid residues forms part of the antigen binding site for binding against at least one epitope of the G-protein of rabies virus.

Aspect B-26: Amino acid sequence that is directed against and/or that can specifically bind at least one epitope of the G-protein of rabies virus, that comprises three or more stretches of amino acid residues, in which the first stretch of amino acid residues is chosen from the group consisting of:

a) the amino acid sequences of SEQ ID NO's: 801 to 811 and 2756 to 2789;

b) amino acid sequences that have at least 80% amino acid identity with at least one of the amino acid sequences of SEQ ID NO's: 801 to 811 and 2756 to 2789;

c) amino acid sequences that have 3, 2, or 1 amino acid difference with at least one of the amino acid sequences of SEQ ID NO's: 801 to 811 and 2756 to 2789;

the second stretch of amino acid residues is chosen from the group consisting of:

d) the amino acid sequences of SEQ ID NO's: 1365 to 1375 and 2828 to 2861;

e) amino acid sequences that have at least 80% amino acid identity with at least one of the amino acid sequences of SEQ ID NO's: 1365 to 1375 and 2828 to 2861;

f) amino acid sequences that have 3, 2, or 1 amino acid difference with at least one of the amino acid sequences of SEQ ID NO's: 1365 to 1375 and 2828 to 2861;

and the third stretch of amino acid residues is chosen from the group consisting of:

g) the amino acid sequences of SEQ ID NO's: 1929 to 1939 and 2900 to 2933;

h) amino acid sequences that have at least 80% amino acid identity with at least one of the amino acid sequences of SEQ ID NO's: 1929 to 1939 and 2900 to 2933;

i) amino acid sequences that have 3, 2, or 1 amino acid difference with at least one of the amino acid sequences of SEQ ID NO's: 1929 to 1939 and 2900 to 2933.

Such an amino acid sequence may in particular be an amino acid sequence according to any of the aspects A-1 to A-109 and/or B-22 to B-25.

Aspect B-27: Amino acid sequence according to aspect B-26, in which the at least three stretches of amino acid residues forms part of the antigen binding site for binding to at least one epitope of the G-protein of rabies virus.

Aspect B-28: Amino acid sequence that is directed against and/or that can specifically bind at least one epitope of the G-protein of rabies virus, in which the CDR sequences of said amino acid sequence have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 237 to 247 and 2684 to 2717. Such an amino acid sequence may in particular be an amino acid sequence according to any of the aspects A-1 to A-109 and/or B-22 to B-27.

Aspect C-13: Amino acid sequence directed against at least one epitope of the G-protein of rabies virus that cross-blocks the binding of at least one of the amino acid sequences of SEQ ID NO's: 237 to 247 and 2684 to 2717 to said at least one epitope of the G-protein of rabies virus. Such an amino acid sequence may in particular be an amino acid sequence according to any of the aspects A-1 to A-109 and/or according to aspects B-22 to B-28. Also, preferably, such an amino acid sequence is able to specifically bind to the G-protein of rabies virus.

Aspect C-14: Amino acid sequence directed against at least one epitope of the G-protein of rabies virus that is cross-blocked from binding to said at least one epitope of the G-protein of rabies virus by at least one of the amino acid sequences of SEQ ID NO's: 237 to 247 and 2684 to 2717. Such an amino acid sequence may in particular be an amino acid sequence according to any of the aspects A-1 to A-109 and/or according to aspects B-22 to B-28. Also, preferably, such an amino acid sequence is able to specifically bind to the G-protein of rabies virus.

Aspect C-15: Amino acid sequence according to any of aspects C-13 or C-14, wherein the ability of said amino acid sequence to cross-block or to be cross-blocked is detected in a Biacore assay.

Aspect C-16: Amino acid sequence according to any of aspects C-13 or C-14 wherein the ability of said amino acid sequence to cross-block or to be cross-blocked is detected in an ELISA assay.

Aspect D-1: Amino acid sequence according to any of aspects B-1 to B-28 or C-1 to C-16, that is in essentially isolated form.

Aspect D-2: Amino acid sequence according to any of aspects B-1 to B-28 or C-1 to C-16 and/or D-1, for administration to a subject, wherein said amino acid sequence does not naturally occur in said subject.

Aspect D-3: Amino acid sequence according to any of aspects B-1 to B-28 or C-1 to C-16 and/or D-1 to D-2, that can specifically bind to at least one epitope of an envelope protein of a virus with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter.

Aspect D-4: Amino acid sequence according to any of aspects B-1 to B-28 or C-1 to C-16 and/or D-1 to D-3, that can specifically bind to at least one epitope of an envelope protein of a virus with a rate of association ($k_{on}$-rate) of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$.

Aspect D-5: Amino acid sequence according to any of aspects B-1 to B-28 or C-1 to C-16 and/or D-1 to D-4, that can specifically bind to at least one epitope of an envelope protein of a virus with a rate of dissociation ($k_{off}$ rate) between 1 $s^{-1}$ and $10^{-6}$ $s^{-1}$ preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Aspect D-6: Amino acid sequence according to any of aspects B-1 to B-28 or C-1 to C-16 and/or D-1 to D-5, that can specifically bind to at least one epitope of an envelope protein of a virus with an affinity less than 500 nM, preferably less than 200 nM, more preferably less than 10 nM, such as less than 500 pM.

The amino acid sequences according to aspects D-1 to D-6 may in particular be an amino acid sequence according to any of the aspects A-1 to A-109.

Aspect E-1: Amino acid sequence according to any of aspects B-1 to B-28 or C-1 to C-16 and/or D-1 to D-6, that is a naturally occurring amino acid sequence (from any suitable species) or a synthetic or semi-synthetic amino acid sequence.

Aspect E-2: Amino acid sequence according to any of aspects B-1 to B-28 or C-1 to C-16, D-1 to D-5 and/or E-1, that comprises an immunoglobulin fold or that under suitable conditions is capable of forming an immunoglobulin fold.

Aspect E-3: Amino acid sequence according to any of aspects B-1 to B-28 or C-1 to C-16, D-1 to D-5 and/or E-1 to E-2, that is an immunoglobulin sequence.

Aspect E-4: Amino acid sequence according to any of aspects B-1 to B-28 or C-1 to C-16, D-1 to D-5 and/or E-1 to E-3, that is a naturally occurring immunoglobulin sequence (from any suitable species) or a synthetic or semi-synthetic immunoglobulin sequence.

Aspect E-5: Amino acid sequence according to any of aspects B-1 to B-28 or C-1 to C-16, D-1 to D-5 and/or E-1 to E-4, that is a humanized immunoglobulin sequence, a camelized immunoglobulin sequence or an immunoglobulin sequence that has been obtained by techniques such as affinity maturation.

Aspect E-6: Amino acid sequence according to any of aspects B-1 to B-28 or C-1 to C-16, D-1 to D-5 and/or E-1 to E-5, that essentially consists of a light chain variable domain sequence (e.g. a $V_L$-sequence); or of a heavy chain variable domain sequence (e.g. a $V_H$-sequence).

Aspect E-7: Amino acid sequence according to any of aspects B-1 to B-28 or C-1 to C-16, D-1 to D-5 and/or E-1 to E-6, that essentially consists of a heavy chain variable domain sequence that is derived from a conventional four-chain antibody or that essentially consist of a heavy chain variable domain sequence that is derived from heavy chain antibody.

Aspect E-8: Amino acid sequence according to any of aspects B-1 to B-28 or C-1 to C-16, D-1 to D-5 and/or E-1 to E-7, that essentially consists of a domain antibody (or an amino acid sequence that is suitable for use as a domain antibody), of a single domain antibody (or an amino acid sequence that is suitable for use as a single domain antibody), of a "dAb" (or an amino acid sequence that is suitable for use as a dAb) or of a NANOBODY® ($V_{HH}$ sequence) (including but not limited to a $V_{HH}$ sequence).

Aspect E-9: Amino acid sequence according to any of aspects B-1 to B-28 or C-1 to C-16, D-1 to D-5 and/or E-1 to E-8, that essentially consists of a NANOBODY® ($V_{HH}$ sequence).

Aspect E-10: Amino acid sequence according to any of aspects B-1 to B-28 or C-1 to C-16, D-1 to D-5 and/or E-1 to E-9, that essentially consists of a NANOBODY® ($V_{HH}$ sequence) that a. has at least 80% amino acid identity with at least one of the amino acid sequences of SEQ ID NO's: 1 to 22, in which for the purposes of determining the degree of amino acid identity, the amino acid residues that form the CDR sequences are disregarded;

and in which:

b. preferably one or more of the amino acid residues at positions 11, 37, 44, 45, 47, 83, 84, 103, 104 and 108 according to the Kabat numbering are chosen from the Hallmark residues mentioned in Table B-2.

Aspect E-11: Amino acid sequence according to any of aspects B-1 to B-28 or C-1 to C-16, D-1 to D-5 and/or E-1 to E-10, that essentially consists of a NANOBODY® ($V_{HH}$ sequence) that a. has at least 80% amino acid identity with at least one of the amino acid sequences of SEQ ID NO's: 126 to 407, 2431 to 2448, 2574 to 2581, 2682 to 2717 and 3064 to 3128, in which for the purposes of determining the degree of amino acid identity, the amino acid residues that form the CDR sequences are disregarded;

and in which:

b. preferably one or more of the amino acid residues at positions 11, 37, 44, 45, 47, 83, 84, 103, 104 and 108 according to the Kabat numbering are chosen from the Hallmark residues mentioned in Table B-2.

Aspect E-12: Amino acid sequence according to any of aspects B-1 to B-28 or C-1 to C-16, D-1 to D-5 and/or E-1 to E-11, that essentially consists of a humanized NANOBODY® ($V_{HH}$ sequence).

Aspect E-13: Amino acid sequence according to aspect E-12, that essentially consists of a humanized NANOBODY® ($V_{HH}$ sequence) which can bind (as further defined herein) to an envelope protein of a virus and which:

i) is a humanized variant of one of the amino acid sequences of SEQ ID NO's: 126 to 407, 2431 to 2448, 2574 to 2581, 2682 to 2717 and 3064 to 3128 (see Table A-1); and/or ii) has at least 80% amino acid identity with at least one of the amino acid sequences of SEQ ID NO's: 126 to 407, 2431 to 2448, 2574 to 2581, 2682 to 2717 and 3064 to 3128 (see Table A-1) and/or at least one of the amino acid sequences of SEQ ID NO's: 2999 to 3015 (see Table A-8), in which for the purposes of determining the degree of amino acid identity, the amino acid residues that form the CDR sequences are disregarded;

and in which:

iii) preferably one or more of the amino acid residues at positions 11, 37, 44, 45, 47, 83, 84, 103, 104 and 108 according to the Kabat numbering are chosen from the Hallmark residues mentioned in Table B-2 below.

Aspect E-14: Amino acid sequence according to any of aspects B-1 to B-28 or C-1 to C-16, D-1 to D-5 and/or E-1 to E-14, that in addition to the at least one binding site for binding formed by the CDR sequences, contains one or more further binding sites for binding against other antigens, proteins or targets.

The amino acid sequences according to aspects E-1 to E-14 may in particular be an amino acid sequence according to any of the aspects A-1 to A-109.

Aspect F-1: Amino acid sequence that essentially consists of 4 framework regions (FR1 to FR4, respectively) and 3 complementarity determining regions (CDR1 to CDR3, respectively), in which:

CDR1 is chosen from the group consisting of:

a. the amino acid sequences of SEQ ID NO's: 690 to 971, 2467 to 2484, 2590 to 2597, 2754 to 2789 and 3194 to 3258;

b. amino acid sequences that have at least 80% amino acid identity with at least one of the amino acid sequences of SEQ ID NO's: 690 to 971, 2467 to 2484, 2590 to 2597, 2754 to 2789 and 3194 to 3258;

c. amino acid sequences that have 3, 2, or 1 amino acid difference with at least one of the amino acid sequences of SEQ ID NO's: 690 to 971, 2467 to 2484, 2590 to 2597, 2754 to 2789 and 3194 to 3258;

and/or

CDR2 is chosen from the group consisting of:

d. the amino acid sequences of SEQ ID NO's: 1254 to 1535, 2503 to 2520, 2606 to 2613, 2826 to 2861 and 3324 to 3388;

e. amino acid sequences that have at least 80% amino acid identity with at least one of the amino acid sequences of SEQ ID NO's: 1254 to 1535, 2503 to 2520, 2606 to 2613, 2826 to 2861 and 3324 to 3388;

f. amino acid sequences that have 3, 2, or 1 amino acid difference with at least one of the amino acid sequences of SEQ ID NO's: 1254 to 1535, 2503 to 2520, 2606 to 2613, 2826 to 2861 and 3324 to 3388;

and/or

CDR3 is chosen from the group consisting of:

g. the amino acid sequences of SEQ ID NO's: 1818 to 2099, 2539 to 2556, 2622 to 2629, 2898 to 2933 and 3454 to 3518;

h. amino acid sequences that have at least 80% amino acid identity with at least one of the amino acid sequences of SEQ ID NO's: 1818 to 2099, 2539 to 2556, 2622 to 2629, 2898 to 2933 and 3454 to 3518;

i. amino acid sequences that have 3, 2, or 1 amino acid difference with at least one of the amino acid sequences of SEQ ID NO's: 1818 to 2099, 2539 to 2556, 2622 to 2629, 2898 to 2933 and 3454 to 3518.

Such an amino acid sequence is preferably directed against an envelope protein of a virus and/or an amino acid sequence that can specifically bind to an envelope protein of a virus. Also, such an amino acid sequence is preferably an amino acid sequence according to any of the aspects A-1 to A-109, C-1 to C-16, D1 to D-6 and/or E-1 to E-14.

Aspect F-2: Amino acid sequence that essentially consists of 4 framework regions (FR1 to FR4, respectively) and 3 complementarity determining regions (CDR1 to CDR3, respectively), in which:

CDR1 is chosen from the group consisting of:

a. the amino acid sequences of SEQ ID NO's: 690 to 971, 2467 to 2484, 2590 to 2597, 2754 to 2789 and 3194 to 3258;

b. amino acid sequences that have at least 80% amino acid identity with at least one of the amino acid sequences of SEQ ID NO's: 690 to 971, 2467 to 2484, 2590 to 2597, 2754 to 2789 and 3194 to 3258;

c. amino acid sequences that have 3, 2, or 1 amino acid difference with at least one of the amino acid sequences of SEQ ID NO's: 690 to 971, 2467 to 2484, 2590 to 2597, 2754 to 2789 and 3194 to 3258;

and

CDR2 is chosen from the group consisting of:

d. the amino acid sequences of SEQ ID NO's: 1254 to 1535, 2503 to 2520, 2606 to 2613, 2826 to 2861 and 3324 to 3388;

e. amino acid sequences that have at least 80% amino acid identity with at least one of the amino acid sequences of SEQ ID NO's: 1254 to 1535, 2503 to 2520, 2606 to 2613, 2826 to 2861 and 3324 to 3388;

f. amino acid sequences that have 3, 2, or 1 amino acid difference with at least one of the amino acid sequences of SEQ ID NO's: 1254 to 1535, 2503 to 2520, 2606 to 2613, 2826 to 2861 and 3324 to 3388;

and

CDR3 is chosen from the group consisting of:

g. the amino acid sequences of SEQ ID NO's: 1818 to 2099, 2539 to 2556, 2622 to 2629, 2898 to 2933 and 3454 to 3518;

h. amino acid sequences that have at least 80% amino acid identity with at least one of the amino acid sequences of SEQ ID NO's: 1818 to 2099, 2539 to 2556, 2622 to 2629, 2898 to 2933 and 3454 to 3518;

i. amino acid sequences that have 3, 2, or 1 amino acid difference with at least one of the amino acid sequences of SEQ ID NO's: 1818 to 2099, 2539 to 2556, 2622 to 2629, 2898 to 2933 and 3454 to 3518.

Such an amino acid sequence is preferably directed against an envelope protein of a virus and/or an amino acid sequence that can specifically bind to an envelope protein of a virus. Also, such an amino acid sequence is preferably an amino acid sequence according to any of the aspects A-1 to A-109, C-1 to C-16, D1 to D-6 and/or E-1 to E-14.

Aspect F-3: Amino acid sequence according to any of aspects F-1 or F-2, in which the CDR sequences of said amino acid sequence have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 126 to 407, 2431 to 2448, 2574 to 2581, 2682 to 2717 and 3064 to 3128.

Such an amino acid sequence is preferably directed against an envelope protein of a virus and/or an amino acid sequence that can specifically bind to an envelope protein of a virus. Also, such an amino acid sequence is preferably an amino acid sequence according to any of the aspects A-1 to A-109, C-1 to C-16, D1 to D-6 and/or E-1 to E-14.

Aspect F-4: Amino acid sequence directed against an envelope protein of a virus that cross-blocks the binding of at least one of the amino acid sequences of SEQ ID NO's: 126 to 407, 2431 to 2448, 2574 to 2581, 2682 to 2717 and 3064 to 3128 to an envelope protein of a virus.

Aspect F-5: Amino acid sequence directed against an envelope protein of a virus that is cross-blocked from binding to an envelope protein of a virus by at least one of the amino acid sequences of SEQ ID NO's: 126 to 407, 2431 to 2448, 2574 to 2581, 2682 to 2717 and 3064 to 3128.

Aspect F-6: Amino acid sequence according to any of aspects F-4 or F-5, wherein the ability of said amino acid sequence to cross-block or to be cross-blocked is detected in a Biacore assay.

Aspect F-7: Amino acid sequence according to any of aspects F-4 or F-5, wherein the ability of said amino acid sequence to cross-block or to be cross-blocked is detected in an ELISA assay.

Aspect F-8: Amino acid sequence that essentially consists of 4 framework regions (FR1 to FR4, respectively) and 3 complementarity determining regions (CDR1 to CDR3, respectively), in which:

CDR1 is chosen from the group consisting of:

a. the amino acid sequences of SEQ ID NO's: 722 to 800, 812 to 971, 2484 and 2590 to 2597;

b. amino acid sequences that have at least 80% amino acid identity with at least one of the amino acid sequences of SEQ ID NO's: 722 to 800, 812 to 971, 2484 and 2590 to 2597;
c. amino acid sequences that have 3, 2, or 1 amino acid difference with at least one of the amino acid sequences of SEQ ID NO's: 722 to 800, 812 to 971, 2484 and 2590 to 2597;

and/or

CDR2 is chosen from the group consisting of:

d. the amino acid sequences of SEQ ID NO's: 1286 to 1364, 1376 to 1535, 2520 and 2606 to 2613;
e. amino acid sequences that have at least 80% amino acid identity with at least one of the amino acid sequences of SEQ ID NO's: 1286 to 1364, 1376 to 1535, 2520 and 2606 to 2613;
f. amino acid sequences that have 3, 2, or 1 amino acid difference with at least one of the amino acid sequences of SEQ ID NO's: 1286 to 1364, 1376 to 1535, 2520 and 2606 to 2613;

and/or

CDR3 is chosen from the group consisting of:

g. the amino acid sequences of SEQ ID NO's: 1850 to 1928, 1940 to 2099, 2556 and 2622-2629;
h. amino acid sequences that have at least 80% amino acid identity with at least one of the amino acid sequences of SEQ ID NO's: 1850 to 1928, 1940 to 2099, 2556 and 2622-2629;
i. amino acid sequences that have 3, 2, or 1 amino acid difference with at least one of the amino acid sequences of SEQ ID NO's: 1850 to 1928, 1940 to 2099, 2556 and 2622-2629.

Such an amino acid sequence is preferably directed against the F protein of RSV virus and/or an amino acid sequence that can specifically bind to the F protein of RSV virus. Also, such an amino acid sequence is preferably an amino acid sequence according to any of the aspects A-1 to A-109, C-1 to C-16, D1 to D-6 and/or E-1 to E-14.

Aspect F-9: Amino acid sequence that essentially consists of 4 framework regions (FR1 to FR4, respectively) and 3 complementarity determining regions (CDR1 to CDR3, respectively), in which:

CDR1 is chosen from the group consisting of:

a. the amino acid sequences of SEQ ID NO's: 722 to 800, 812 to 971, 2484 and 2590 to 2597;
b. amino acid sequences that have at least 80% amino acid identity with at least one of the amino acid sequences of SEQ ID NO's: 722 to 800, 812 to 971, 2484 and 2590 to 2597;
c. amino acid sequences that have 3, 2, or 1 amino acid difference with at least one of the amino acid sequences of SEQ ID NO's: 722 to 800, 812 to 971, 2484 and 2590 to 2597;

and

CDR2 is chosen from the group consisting of:

d. the amino acid sequences of SEQ ID NO's: 1286 to 1364, 1376 to 1535, 2520 and 2606 to 2613;
e. amino acid sequences that have at least 80% amino acid identity with at least one of the amino acid sequences of SEQ ID NO's: 1286 to 1364, 1376 to 1535, 2520 and 2606 to 2613;
f. amino acid sequences that have 3, 2, or 1 amino acid difference with at least one of the amino acid sequences of SEQ ID NO's: 1286 to 1364, 1376 to 1535, 2520 and 2606 to 2613;

and

CDR3 is chosen from the group consisting of:

g. the amino acid sequences of SEQ ID NO's: 1850 to 1928, 1940 to 2099, 2556 and 2622-2629;
h. amino acid sequences that have at least 80% amino acid identity with at least one of the amino acid sequences of SEQ ID NO's: 1850 to 1928, 1940 to 2099, 2556 and 2622-2629;
i. amino acid sequences that have 3, 2, or 1 amino acid difference with at least one of the amino acid sequences of SEQ ID NO's: 1850 to 1928, 1940 to 2099, 2556 and 2622-2629.

Such an amino acid sequence is preferably directed against the F protein of RSV virus and/or an amino acid sequence that can specifically bind to the F protein of RSV virus. Also, such an amino acid sequence is preferably an amino acid sequence according to any of the aspects A-1 to A-109, C-1 to C-16, D1 to D-6 and/or E-1 to E-14.

Aspect F-10: Amino acid sequence according to any of aspects F-8 or F-9, in which the CDR sequences of said amino acid sequence have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 158 to 236, 248 to 407, 2448 and 2574 to 2581.

Such an amino acid sequence is preferably directed against the F protein of RSV virus and/or an amino acid sequence that can specifically bind to the F protein of RSV virus. Also, such an amino acid sequence is preferably an amino acid sequence according to any of the aspects A-1 to A-109, C-1 to C-16, D1 to D-6 and/or E-1 to E-14.

Aspect F-11: Amino acid sequence directed against the F protein of RSV virus that cross-blocks the binding of at least one of the amino acid sequences of SEQ ID NO's: 158 to 236, 248 to 407, 2448 and 2574 to 2581 to the F protein of RSV virus.

Aspect F-12: Amino acid sequence directed against the F protein of RSV virus that is cross-blocked from binding to the F protein of RSV virus by at least one of the amino acid sequences of SEQ ID NO's: 158 to 236, 248 to 407, 2448 and 2574 to 2581.

Aspect F-13: Amino acid sequence according to any of aspects F-11 or F-12, wherein the ability of said amino acid sequence to cross-block or to be cross-blocked is detected in a Biacore assay.

Aspect F-14: Amino acid sequence according to any of aspects F-11 or F-12, wherein the ability of said amino acid sequence to cross-block or to be cross-blocked is detected in an ELISA assay.

Aspect F-15: Amino acid sequence that essentially consists of 4 framework regions (FR1 to FR4, respectively) and 3 complementarity determining regions (CDR1 to CDR3, respectively), in which:

CDR1 is chosen from the group consisting of:

a. the amino acid sequences of SEQ ID NO's: 690 to 721, 2467 to 2483, 2754 to 2755 and 3194 to 3258;
b. amino acid sequences that have at least 80% amino acid identity with at least one of the amino acid sequences of SEQ ID NO's: 690 to 721, 2467 to 2483, 2754 to 2755 and 3194 to 3258;
c. amino acid sequences that have 3, 2, or 1 amino acid difference with at least one of the amino acid sequences of SEQ ID NO's: 690 to 721, 2467 to 2483, 2754 to 2755 and 3194 to 3258;

and/or

CDR2 is chosen from the group consisting of:

d. the amino acid sequences of SEQ ID NO's: 1254 to 1285, 2503 to 2519, 2826 to 2827 and 3324 to 3388;

e. amino acid sequences that have at least 80% amino acid identity with at least one of the amino acid sequences of SEQ ID NO's: 1254 to 1285, 2503 to 2519, 2826 to 2827 and 3324 to 3388;

f. amino acid sequences that have 3, 2, or 1 amino acid difference with at least one of the amino acid sequences of SEQ ID NO's: 1254 to 1285, 2503 to 2519, 2826 to 2827 and 3324 to 3388;

and/or

CDR3 is chosen from the group consisting of:

g. the amino acid sequences of SEQ ID NO's: 1818 to 1849, 2539 to 2555, 2898 to 2899 and 3454 to 3518;

h. amino acid sequences that have at least 80% amino acid identity with at least one of the amino acid sequences of SEQ ID NO's: 1818 to 1849, 2539 to 2555, 2898 to 2899 and 3454 to 3518;

i. amino acid sequences that have 3, 2, or 1 amino acid difference with at least one of the amino acid sequences of SEQ ID NO's: 1818 to 1849, 2539 to 2555, 2898 to 2899 and 3454 to 3518.

Such an amino acid sequence is preferably directed against the hemagglutinin H5 of influenza virus and/or an amino acid sequence that can specifically bind to the hemagglutinin H5 of influenza virus. Also, such an amino acid sequence is preferably an amino acid sequence according to any of the aspects A-1 to A-109, C-1 to C-16, D1 to D-6 and/or E-1 to E-14.

Aspect F-16: Amino acid sequence that essentially consists of 4 framework regions (FR1 to FR4, respectively) and 3 complementarity determining regions (CDR1 to CDR3, respectively), in which:

CDR1 is chosen from the group consisting of:

a. the amino acid sequences of SEQ ID NO's: 690 to 721, 2467 to 2483, 2754 to 2755 and 3194 to 3258;

b. amino acid sequences that have at least 80% amino acid identity with at least one of the amino acid sequences of SEQ ID NO's: 690 to 721, 2467 to 2483, 2754 to 2755 and 3194 to 3258;

c. amino acid sequences that have 3, 2, or 1 amino acid difference with at least one of the amino acid sequences of SEQ ID NO's: 690 to 721, 2467 to 2483, 2754 to 2755 and 3194 to 3258;

and

CDR2 is chosen from the group consisting of:

d. the amino acid sequences of SEQ ID NO's: 1254 to 1285, 2503 to 2519, 2826 to 2827 and 3324 to 3388;

e. amino acid sequences that have at least 80% amino acid identity with at least one of the amino acid sequences of SEQ ID NO's: 1254 to 1285, 2503 to 2519, 2826 to 2827 and 3324 to 3388;

f. amino acid sequences that have 3, 2, or 1 amino acid difference with at least one of the amino acid sequences of SEQ ID NO's: 1254 to 1285, 2503 to 2519, 2826 to 2827 and 3324 to 3388;

and

CDR3 is chosen from the group consisting of:

g. the amino acid sequences of SEQ ID NO's: 1818 to 1849, 2539 to 2555, 2898 to 2899 and 3454 to 3518;

h. amino acid sequences that have at least 80% amino acid identity with at least one of the amino acid sequences of SEQ ID NO's: 1818 to 1849, 2539 to 2555, 2898 to 2899 and 3454 to 3518;

i. amino acid sequences that have 3, 2, or 1 amino acid difference with at least one of the amino acid sequences of SEQ ID NO's: 1818 to 1849, 2539 to 2555, 2898 to 2899 and 3454 to 3518.

Such an amino acid sequence is preferably directed against the hemagglutinin H5 of influenza virus and/or an amino acid sequence that can specifically bind to the hemagglutinin H5 of influenza virus. Also, such an amino acid sequence is preferably an amino acid sequence according to any of the aspects A-1 to A-109, C-1 to C-16, D1 to D-6 and/or E-1 to E-14.

Aspect F-17: Amino acid sequence according to any of aspects F-15 or F-16, in which the CDR sequences of said amino acid sequence have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 126 to 157, 2431 to 2447, 2682 to 2683 and 3064 to 3128.

Such an amino acid sequence is preferably directed against the hemagglutinin H5 of influenza virus and/or an amino acid sequence that can specifically bind to the hemagglutinin H5 of influenza virus. Also, such an amino acid sequence is preferably an amino acid sequence according to any of the aspects A-1 to A-109, C-1 to C-16, D1 to D-6 and/or E-1 to E-14.

Aspect F-18: Amino acid sequence directed against the hemagglutinin H5 of influenza virus that cross-blocks the binding of at least one of the amino acid sequences of SEQ ID NO's: 126 to 157, 2431 to 2447, 2682 to 2683 and 3064 to 3128 to the hemagglutinin H5 of influenza virus.

Aspect F-19: Amino acid sequence directed against the hemagglutinin H5 of influenza virus that is cross-blocked from binding to the hemagglutinin H5 of influenza virus by at least one of the amino acid sequences of SEQ ID NO's: 126 to 157, 2431 to 2447, 2682 to 2683 and 3064 to 3128.

Aspect F-20: Amino acid sequence according to any of aspects F-18 or F-19, wherein the ability of said amino acid sequence to cross-block or to be cross-blocked is detected in a Biacore assay.

Aspect F-21: Amino acid sequence according to any of aspects F-18 or F-19, wherein the ability of said amino acid sequence to cross-block or to be cross-blocked is detected in an ELISA assay.

Aspect F-22: Amino acid sequence that essentially consists of 4 framework regions (FR1 to FR4, respectively) and 3 complementarity determining regions (CDR1 to CDR3, respectively), in which:

CDR1 is chosen from the group consisting of:

a. the amino acid sequences of SEQ ID NO's: 801 to 811 and 2756 to 2789;

b. amino acid sequences that have at least 80% amino acid identity with at least one of the amino acid sequences of SEQ ID NO's: 801 to 811 and 2756 to 2789;

c. amino acid sequences that have 3, 2, or 1 amino acid difference with at least one of the amino acid sequences of SEQ ID NO's: 801 to 811 and 2756 to 2789;

and/or

CDR2 is chosen from the group consisting of:

d. the amino acid sequences of SEQ ID NO's: 1365 to 1375 and 2828 to 2861;

e. amino acid sequences that have at least 80% amino acid identity with at least one of the amino acid sequences of SEQ ID NO's: 1365 to 1375 and 2828 to 2861;

f. amino acid sequences that have 3, 2, or 1 amino acid difference with at least one of the amino acid sequences of SEQ ID NO's: 1365 to 1375 and 2828 to 2861;

and/or

CDR3 is chosen from the group consisting of:

g. the amino acid sequences of SEQ ID NO's: 1929 to 1939 and 2900 to 2933;

h. amino acid sequences that have at least 80% amino acid identity with at least one of the amino acid sequences of SEQ ID NO's: 1929 to 1939 and 2900 to 2933;

i. amino acid sequences that have 3, 2, or 1 amino acid difference with at least one of the amino acid sequences of SEQ ID NO's: 1929 to 1939 and 2900 to 2933.

Such an amino acid sequence is preferably directed against the G envelope protein of rabies virus and/or an amino acid sequence that can specifically bind to the G envelope protein of rabies virus. Also, such an amino acid sequence is preferably an amino acid sequence according to any of the aspects A-1 to A-109, C-1 to C-16, D1 to D-6 and/or E-1 to E-14.

Aspect F-23: Amino acid sequence that essentially consists of 4 framework regions (FR1 to FR4, respectively) and 3 complementarity determining regions (CDR1 to CDR3, respectively), in which:

CDR1 is chosen from the group consisting of:

a. the amino acid sequences of SEQ ID NO's: 801 to 811 and 2756 to 2789;

b. amino acid sequences that have at least 80% amino acid identity with at least one of the amino acid sequences of SEQ ID NO's: 801 to 811 and 2756 to 2789;

c. amino acid sequences that have 3, 2, or 1 amino acid difference with at least one of the amino acid sequences of SEQ ID NO's: 801 to 811 and 2756 to 2789;

and

CDR2 is chosen from the group consisting of:

d. the amino acid sequences of SEQ ID NO's: 1365 to 1375 and 2828 to 2861;

e. amino acid sequences that have at least 80% amino acid identity with at least one of the amino acid sequences of SEQ ID NO's: 1365 to 1375 and 2828 to 2861;

f. amino acid sequences that have 3, 2, or 1 amino acid difference with at least one of the amino acid sequences of SEQ ID NO's: 1365 to 1375 and 2828 to 2861;

and

CDR3 is chosen from the group consisting of:

g. the amino acid sequences of SEQ ID NO's: 1929 to 1939 and 2900 to 2933;

h. amino acid sequences that have at least 80% amino acid identity with at least one of the amino acid sequences of SEQ ID NO's: 1929 to 1939 and 2900 to 2933;

i. amino acid sequences that have 3, 2, or 1 amino acid difference with at least one of the amino acid sequences of SEQ ID NO's: 1929 to 1939 and 2900 to 2933.

Such an amino acid sequence is preferably directed against the G envelope protein of rabies virus and/or an amino acid sequence that can specifically bind to the G envelope protein of rabies virus. Also, such an amino acid sequence is preferably an amino acid sequence according to any of the aspects A-1 to A-109, C-1 to C-16, D1 to D-6 and/or E-1 to E-14.

Aspect F-24: Amino acid sequence according to any of aspects F-22 or F-23, in which the CDR sequences of said amino acid sequence have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 237 to 247 and 2684 to 2717.

Such an amino acid sequence is preferably directed against the G envelope protein of rabies virus and/or an amino acid sequence that can specifically bind to the G envelope protein of rabies virus. Also, such an amino acid sequence is preferably an amino acid sequence according to any of the aspects A-1 to A-109, C-1 to C-16, D1 to D-6 and/or E-1 to E-14.

Aspect F-25: Amino acid sequence directed against the G envelope protein of rabies virus that cross-blocks the binding of at least one of the amino acid sequences of SEQ ID NO's: 237 to 247 and 2684 to 2717 to the G envelope protein of rabies virus.

Aspect F-26: Amino acid sequence directed against the G envelope protein of rabies virus that is cross-blocked from binding to the G envelope protein of rabies virus by at least one of the amino acid sequences of SEQ ID NO's: 237 to 247 and 2684 to 2717.

Aspect F-27: Amino acid sequence according to any of aspects F-25 or F-26, wherein the ability of said amino acid sequence to cross-block or to be cross-blocked is detected in a Biacore assay.

Aspect F-28: Amino acid sequence according to any of aspects F-25 or F-26, wherein the ability of said amino acid sequence to cross-block or to be cross-blocked is detected in an ELISA assay.

Aspect F-29: Amino acid sequence according to any of aspects F-1 to F-28, that is in essentially isolated form.

Aspect F-30: Amino acid sequence according to any of aspects F-1 to F-29, for administration to a subject, wherein said amino acid sequence does not naturally occur in said subject.

Aspect F-31: Amino acid sequence according to any of aspects F-1 to F-30, that can specifically bind to at least one epitope of an envelope protein of a virus with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter.

Aspect F-32: Amino acid sequence according to any of aspects F-1 to F-31, that can specifically bind to at least one epitope of an envelope protein of a virus with a rate of association ($k_{on}$-rate) of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$.

Aspect F-33: Amino acid sequence according to any of aspects F-1 to F-32, that can specifically bind to at least one epitope of an envelope protein of a virus with a rate of dissociation ($k_{off}$ rate) between 1 $s^{-1}$ and $10^{-6}$ $s^{-1}$ preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Aspect F-34: Amino acid sequence according to any of aspects F-1 to F-33, that can specifically bind to at least one epitope of an envelope protein of a virus with an affinity less than 500 nM, preferably less than 200 nM, more preferably less than 10 nM, such as less than 500 pM.

Aspect F-35: Amino acid sequence according to any of aspects F-1 to F-34, that is a naturally occurring amino acid sequence (from any suitable species) or a synthetic or semi-synthetic amino acid sequence.

Aspect F-36: Amino acid sequence according to any of aspects F-1 to F-35, that comprises an immunoglobulin fold or that under suitable conditions is capable of forming an immunoglobulin fold.

Aspect F-37: Amino acid sequence according to any of aspects F-1 to F-36, that is an immunoglobulin sequence.

Aspect F-38: Amino acid sequence according to any of aspects F-1 to F-37, that is a naturally occurring immunoglobulin sequence (from any suitable species) or a synthetic or semi-synthetic immunoglobulin sequence.

Aspect F-39: Amino acid sequence according to any of aspects F-1 to F-38, that is a humanized immunoglobulin sequence, a camelized immunoglobulin sequence or an immunoglobulin sequence that has been obtained by techniques such as affinity maturation.

Aspect F-40: Amino acid sequence according to any of aspects F-1 to F-39, that essentially consists of a light chain variable domain sequence (e.g. a $V_L$-sequence); or of a heavy chain variable domain sequence (e.g. a $V_H$-sequence).

Aspect F-41: Amino acid sequence according to any of aspects F-1 to F-40, that essentially consists of a heavy chain variable domain sequence that is derived from a conventional four-chain antibody or that essentially consist of a heavy chain variable domain sequence that is derived from heavy chain antibody.

Aspect F-42: Amino acid sequence according to any of aspects F-1 to F-41, that essentially consists of a domain antibody (or an amino acid sequence that is suitable for use as a domain antibody), of a single domain antibody (or an amino acid sequence that is suitable for use as a single domain antibody), of a "dAb" (or an amino acid sequence that is suitable for use as a dAb) or of a NANOBODY® ($V_{HH}$ sequence) (including but not limited to a $V_{HH}$ sequence).

Aspect F-43: Amino acid sequence according to any of aspects F-1 to F-42, that essentially consists of a NANOBODY® ($V_{HH}$ sequence).

Aspect F-44: Amino acid sequence according to any of aspects F-1 to F-43, that essentially consists of a NANOBODY® ($V_{HH}$ sequence) that a. has at least 80% amino acid identity with at least one of the amino acid sequences of SEQ ID NO's: 1 to 22, in which for the purposes of determining the degree of amino acid identity, the amino acid residues that form the CDR sequences are disregarded;

and in which:

b. preferably one or more of the amino acid residues at positions 11, 37, 44, 45, 47, 83, 84, 103, 104 and 108 according to the Kabat numbering are chosen from the Hallmark residues mentioned in Table B-2.

Aspect F-45: Amino acid sequence according to any of aspects F-1 to F-44, that essentially consists of a NANOBODY® ($V_{HH}$ sequence) that:

a. has at least 80% amino acid identity with at least one of the amino acid sequences of SEQ ID NO's: 126 to 407, 2431 to 2448, 2574 to 2581, 2682 to 2717 and 3064 to 3128, in which for the purposes of determining the degree of amino acid identity, the amino acid residues that form the CDR sequences are disregarded;

and in which:

b. preferably one or more of the amino acid residues at positions 11, 37, 44, 45, 47, 83, 84, 103, 104 and 108 according to the Kabat numbering are chosen from the Hallmark residues mentioned in Table B-2.

Aspect F-46: Amino acid sequence according to any of aspects F-1 to F-45, that essentially consists of a humanized NANOBODY® ($V_{HH}$ sequence).

Aspect F-47: Amino acid sequence according to any of aspects F-1 to F-46, that in addition to the at least one binding site for binding formed by the CDR sequences, contains one or more further binding sites for binding against other antigens, proteins or targets.

Aspect H-1: NANOBODY® ($V_{HH}$ sequence) that is directed against and/or that can specifically bind to an envelope protein of a virus.

Aspect H-2: NANOBODY® ($V_{HH}$ sequence) according to aspect H-1, wherein said NANOBODY® ($V_{HH}$ sequence) modulates the interaction between said envelope protein and at least one binding partner.

Aspect H-3: NANOBODY® ($V_{HH}$ sequence) according to aspects H-1 or H-2, wherein said NANOBODY® ($V_{HH}$ sequence) inhibits and/or prevents the interaction between said envelope protein and at least one binding partner.

Aspect H-4: NANOBODY® ($V_{HH}$ sequence) according to any of aspects H-1 to H-3, wherein said NANOBODY® ($V_{HH}$ sequence) competes with said binding partner for binding to said envelope protein.

Aspect H-5: NANOBODY® ($V_{HH}$ sequence) according to aspect H-4, wherein said at least one binding partner is a viral receptor for an envelope protein of a virus.

Aspect H-6: NANOBODY® ($V_{HH}$ sequence) according to aspect H-5, wherein said viral receptor is chosen from the group consisting of sialic acid, soluble (2,3)-sialic acid, (2,6)-sialic acid, CD4, CCR5, CXCR4, galactosylceramide, ACE2, HveA, CD155, ICAM-1, CAR, αv integrins, heparin sulphate proteoglycans, JAM-1, the Nicotinic Acetylcholine Receptor (AchR), and the Nueral Cell Adhesion Molecule (NCAM).

Aspect H-7: NANOBODY® ($V_{HH}$ sequence) according to aspects H-5 or H-6, wherein said interaction between an envelope protein and a viral receptor is chosen from the group consisting of the interaction of HA of influenza A virus with sialic acid; (2,3) sialic acid; and/or (2,6) sialic acid; the interaction of gp120 of HIV-1 virus with CD4; CCR5; CXCR4; and/or galactosylceramide; the interaction of S1 of SARS coronavirus with ACE2; the interaction of gD; gB; and/or gC; the interaction of the heterodimer gH/gL of herpes simplex 1 virus with HveA; the interaction of VP1; VP2; and/or VP3 of poliovirus 1 with CD155; the interaction of VP1; VP2; and/or VP3 of rhinovirus 3 with ICAM-1; the interaction of adenovirus 2 fibre with CAR; the interaction of adenovirus 2 penton base with αv integrins; sialic acid; (2,3) sialic acid; (2,6) sialic acid; and/or heparin sulphate proteoglycans; the interaction of σ1 of reovirus 1 with JAM-1; sialic acid; (2,3) sialic acid; and/or (2,6) sialic acid; and the interaction of G-protein of rabies virus with the Nicotinic Acetylcholine Receptor (AchR); and/or the Nueral Cell Adhesion Molecule (NCAM).

Aspect H-8: NANOBODY® ($V_{HH}$ sequence) according to aspect H-4, wherein said at least one binding partner is a monoclonal antibody that is directed against and/or specifically binds to said envelope protein of a virus.

Aspect H-9: NANOBODY® ($V_{HH}$ sequence) according to aspect H-8, wherein said monoclonal antibody is Synagis®, 101F, VN04-2, MAb C179 or MAb 8-2.

Aspect H-10: NANOBODY® ($V_{HH}$ sequence) according to any of aspects H-1 to H-9, wherein said envelope protein is a viral-specific protein.

Aspect H-11: NANOBODY® ($V_{HH}$ sequence) according to any of aspects H-1 to H-9, wherein said envelope protein is a membrane protein.

Aspect H-12: NANOBODY® ($V_{HH}$ sequence) according to any of aspects H-1 to H-11, wherein said envelope protein is a non-glycosylated protein.

Aspect H-13: NANOBODY® ($V_{HH}$ sequence) according to any of aspects H-1 to H-11, wherein said envelope protein is a glycoprotein.

Aspect H-14: NANOBODY® ($V_{HH}$ sequence) according to any of aspects H-1 to H-13, wherein said envelope protein is a viral attachment protein.

Aspect H-15: NANOBODY® ($V_{HH}$ sequence) according to aspect H-14, wherein said viral attachment protein is chosen from the group consisting of the G protein of RSV virus, the HA protein of influenza A virus, the gp120 protein of HIV-1 virus, the S1 protein of SARS Corona virus, the gD protein of Herpes simplex 1 virus, the VP1 and/or VP2 and/or VP3 proteins of Poliovirus 1, the VP1 and/or VP2 and/or VP3 proteins of Rhinovirus 3, fibre and/or penton base of Adenovirus 2 and σ1 of Reovirus 1.

Aspect H-16: NANOBODY® ($V_{HH}$ sequence) according to any of aspects H-1 to H-13, wherein said envelope protein is a viral fusion protein.

Aspect H-17: NANOBODY® ($V_{HH}$ sequence) according to aspect H-16, wherein said viral fusion protein is chosen from the group consisting of the F protein of RSV virus, the HA protein of Influenza A virus, the HEF protein of influenza C virus, the 5 F protein of Simian parainfluenza virus, the F protein of Human parainfluenza virus, the F protein of Newcastle disease virus, the F2 protein of measles, the F2 protein of Sendai virus, the gp2 protein of Ebola virus, the TM protein of Moloney murine leukemia virus, the gp41 protein of Human immunodeficiency virus 1, the gp41 protein of Simian immunodeficiency virus, the gp21 protein of Human T cell leukemia virus 1, the TM protein of Human syncytin-2, the TM protein of Visna virus, the S2 protein of Mouse hepatitis virus, the E2 protein of SARS corona virus, the E protein of Tick-borne encephalitis virus, the E2 protein of Dengue 2 and 3 virus, the E protein of Yellow Fever virus, the E protein of West Nile virus, the E1 protein of Semliki forest virus, the E1 protein of Sindbis virus, the G protein of Rabies virus, the G protein of Vesicular stomatitis virus and the gB protein of Herpes simplex virus.

Aspect H-18: NANOBODY® ($V_{HH}$ sequence) according to any of aspects H-1 to H-17, wherein said envelope protein is a viral attachment protein and a viral fusion protein.

Aspect H-19: NANOBODY® ($V_{HH}$ sequence) according to aspect H-18, wherein said viral attachment protein and viral fusion protein is chosen from the group consisting of the HA protein of influenza A virus, the E2 protein of SARS corona virus, the E protein of Tick-borne encephalitis virus, the E2 protein of Dengue 2 and 3 virus, the E protein of Yellow Fever virus, the E protein of West Nile virus, the E1 protein of Semliki forest virus, and the E1 protein of Sindbis virus.

Aspect H-20: NANOBODY® ($V_{HH}$ sequence) according to aspects H-16 or H-18, wherein said viral fusion protein is characterized by a pre-fusion conformational state and/or an intermediate conformational state and/or a post-fusion conformational state.

Aspect H-21: NANOBODY® ($V_{HH}$ sequence) according to aspect H-20, wherein said viral fusion protein is characterized by a pre-fusion conformational state, which is a fusion protein trimer.

Aspect H-22: NANOBODY® ($V_{HH}$ sequence) according to aspect H-21, wherein said fusion protein trimer is a trimer of hairpins.

Aspect H-23: NANOBODY® ($V_{HH}$ sequence) according to aspects H-21 or H-22, wherein said fusion protein trimer is a six-helix bundle.

Aspect H-24: NANOBODY® ($V_{HH}$ sequence) according to any of aspects H-21 to H-23, wherein said fusion protein is chosen from the group consisting of Influenza A virus HA protein, Influenza C virus HEF protein, Simian parainfluenza virus 5 F protein, Human parainfluenza virus F protein, Newcastle disease virus F protein, Human respiratory syncytial virus F protein, Measles F2 protein, Sendai F2 protein, Ebola virus gp2 protein, Moloney murine leukemia virus TM protein, Human immunodeficiency virus 1 gp41 protein, Simian immunodeficiency virus gp41 protein, Human T cell leukemia virus 1 gp21 protein, Human syncytin-2 TM protein, Visna virus TM protein, Mouse hepatitis virus S2 protein, SARS corona virus E2 protein.

Aspect H-25: NANOBODY® ($V_{HH}$ sequence) according to aspect H-24, wherein said fusion protein is Influenza A virus HA protein.

Aspect H-26: NANOBODY® ($V_{HH}$ sequence) according to aspect H-24, wherein said fusion protein is Human respiratory syncytial virus F protein.

Aspect H-27: NANOBODY® ($V_{HH}$ sequence) according to aspect H-20, wherein said fusion protein is characterized by a pre-fusion conformational state, which is a protein dimer.

Aspect H-28: NANOBODY® ($V_{HH}$ sequence) according to aspect H-27, wherein said dimer is a fusion protein homodimer.

Aspect H-29: NANOBODY® ($V_{HH}$ sequence) according to aspect H-27, wherein said dimer is a protein heterodimer.

Aspect H-30: NANOBODY® ($V_{HH}$ sequence) according to aspect 20, wherein said fusion protein is characterized by a pre-fusion conformational state, which is a fusion protein monomer.

Aspect H-31: NANOBODY® ($V_{HH}$ sequence) according to any of aspects H-27 to H-30, wherein said fusion protein is chosen from the group consisting of Tick-borne encephalitis virus E protein, Dengue 2 and 3 virus E2 protein, yellow fever E protein, West Nile virus E protein, Semliki forest virus E1 protein and Sindbis E1 protein.

Aspect H-32: NANOBODY® ($V_{HH}$ sequence) according to aspect 20, wherein said fusion protein is characterized by a post-fusion conformational state, which is a fusion protein trimer.

Aspect H-33: NANOBODY® ($V_{HH}$ sequence) according to aspect H-32, wherein said fusion protein trimer is a trimer of hairpins.

Aspect H-34: NANOBODY® ($V_{HH}$ sequence) according to aspects H-32 or H-33, wherein said fusion protein trimer is a six-helix bundle.

Aspect H-35: NANOBODY® ($V_{HH}$ sequence) according to aspect H-33, wherein said trimer of hairpins comprises an α-helical coiled coil.

Aspect H-36: NANOBODY® ($V_{HH}$ sequence) according to any of aspects H-32 to H-35, wherein said fusion protein is chosen from the group consisting of Influenza A virus HA protein, Influenza C virus HEF protein, Simian parainfluenza virus 5 F protein, Human parainfluenza virus F protein, Newcastle disease virus F protein, Respiratory syncytial F protein, Measles F2 protein, Sendai F2 protein, Ebola virus gp2 protein, Moloney murine leukemia virus TM protein, Human immunodeficiency virus 1 gp41 protein, Simian immunodeficiency virus gp41 protein, Human T cell leukemia virus 1 gp21 protein, Human syncytin-2 TM protein, Visna virus TM protein, Mouse hepatitis virus S2 protein and SARS corona virus E2 protein.

Aspect H-37: NANOBODY® ($V_{HH}$ sequence) according to aspect H-33, wherein said trimer of hairpins comprises β-structures.

Aspect H-38: NANOBODY® ($V_{HH}$ sequence) according to any of aspects H-32 to H-34 and H-37, wherein said fusion protein is chosen from the group consisting of Tick-borne encephalitis virus E protein, Dengue 2 and 3 virus E2 protein, yellow fever E protein, West Nile virus E protein, Semliki forest virus E1 protein and Sindbis E1 protein.

Aspect H-39: NANOBODY® ($V_{HH}$ sequence) according to any of aspects H-33, H-35 and H-37, wherein said trimer of hairpins comprises an α-helical coiled coil and β-structures.

Aspect H-40: NANOBODY® ($V_{HH}$ sequence) according to aspect H-39, wherein said fusion protein is chosen from the group consisting of vesicular stomatitis virus G protein, Rabies virus G protein and Herpes simplex virus gB protein.

Aspect H-41: NANOBODY® ($V_{HH}$ sequence) according to aspect H-40, wherein said fusion protein is Rabies virus G protein.

Aspect H-42: NANOBODY® ($V_{HH}$ sequence) according to any of aspects H-20 to H-41, wherein said amino acid sequence is directed against and/or can specifically bind to the pre-fusion conformational state and/or the intermediate conformational state and/or the post-fusion conformational state of said fusion protein.

Aspect H-43: NANOBODY® ($V_{HH}$ sequence) according to aspect H-42, wherein said NANOBODY® ($V_{HH}$ sequence) is directed against and/or can specifically bind to the pre-fusion conformational state and/or the intermediate conformational state of said fusion protein.

Aspect H-44: NANOBODY® ($V_{HH}$ sequence) according to aspect H-42, wherein said NANOBODY® ($V_{HH}$ sequence) is directed against and/or can specifically bind to the intermediate conformational state and/or the post-fusion conformational state of said fusion protein.

Aspect H-45: NANOBODY® ($V_{HH}$ sequence) according to aspect H-42, wherein said NANOBODY® ($V_{HH}$ sequence) is directed against and/or can specifically bind to the pre-fusion conformational state and/or the post-fusion conformational state of said fusion protein.

Aspect H-46: NANOBODY® ($V_{HH}$ sequence) according to any of aspects H-21 to H-45, wherein said epitope is located in a cavity or cleft formed by said trimer according to aspects H-21 to H-26 and H-32 to H-41 or formed by said dimer according to claims H-27 to H-31.

Aspect H-47: NANOBODY® ($V_{HH}$ sequence) according to any of aspects H-21 to H-46, wherein said epitope is located in the stem region of said fusion protein.

Aspect H-48: NANOBODY® ($V_{HH}$ sequence) according to aspect H-47, wherein said epitope that is located in the stem region of said fusion protein is chosen from the group consisting of an epitope that is located in the region comprising one or more of the amino acids 318 to 322 of the HA1 subunit of influenza HA and/or the region comprising one or more of the amino acids 47 to 58 of the HA2 subunit of influenza HA, an epitope that is located in the N-terminal region comprising one or more of the amino acids 1 to 38 of the HA2 subunit of influenza HA, an epitope that is located in the region comprising one or more of the amino acids 38 to 112 of the HA2 subunit of influenza HA, an epitope that is located in the region comprising one or more of the amino acids 125 to 175 of the HA2 subunit of influenza HA and an epitope that is located in the region comprising one or more of the amino acids 176 to 185 of the HA2 subunit of influenza HA.

Aspect H-49: NANOBODY® ($V_{HH}$ sequence) according to any of aspects H-21 to H-46, wherein said epitope is located in the neck region of said fusion protein.

Aspect H-50: NANOBODY® ($V_{HH}$ sequence) according to any of aspects H-21 to H-46, wherein said epitope is located in the globular head region of said fusion protein.

Aspect H-51: NANOBODY® ($V_{HH}$ sequence) according to aspect H-50, wherein said globular head region comprises a β-barrel-type structure.

Aspect H-52: NANOBODY® ($V_{HH}$ sequence) according to aspect H-50, wherein said globular head region comprises an immunoglobulin-type β-sandwich domain and a β-sheet domain.

Aspect H-53: NANOBODY® ($V_{HH}$ sequence) according to any of aspects H-1 to H-52, wherein said epitope is chosen from the group consisting of an epitope that is located in the region comprising the A-antigenic site and/or amino acids 255 to 280 of the F-protein of RSV virus, an epitope that is located in the region comprising the Fla site and/or the region comprising amino acid 389 of the F-protein of RSV virus, an epitope that is located in the region comprising amino acids 422 to 438 of the F-protein of RSV virus, an epitope that is located in the region comprising the sialic acid binding site of the H5 HA envelope protein of influenza virus, an epitope that is located in the region comprising the Nicotinic Acetylcholine Receptor (AchR) and/or the Nueral Cell Adhesion Molecule (NCAM) binding site of the G-protein of rabies virus, an epitope that is located in the C-terminal region of a fusion protein, an epitope that is located in the N-terminal domain of a fusion protein, an epitope that is located in or comprises the fusion peptide of a fusion protein, an epitope that is located in the transmembrane domain of a fusion protein, an epitope that is located in a α-helical coiled-coil of a fusion protein, an epitope that is located in a β-structure of a fusion protein, an epitope that is located in Domain I of a fusion protein, an epitope that is located in Domain II of a fusion protein and an epitope that is located in Domain III of a fusion protein.

Aspect H-54: NANOBODY® ($V_{HH}$ sequence) according to aspect H-53, wherein said epitope that is located in Domain II of a fusion protein is an epitope that is located in the fusion peptide of Domain II of a fusion protein.

Aspect H-55: NANOBODY® ($V_{HH}$ sequence) according to aspect H-53, wherein said epitope that is located in Domain III of a fusion protein is chosen from the group consisting of an epitope that is located in the stem region at the C-terminus of Domain III of a fusion protein and an epitope that is located in the transmembrane anchor at the C-terminus of Domain III of a fusion protein.

Aspect H-56: NANOBODY® ($V_{HH}$ sequence) according to any of aspects H-1 to H-55, wherein said virus is chosen from the group consisting of a DNA virus, an RNA virus and a Reverse Transcriptase (RT) virus.

Aspect H-57: NANOBODY® ($V_{HH}$ sequence) according to aspect H-56, wherein said DNA virus is chosen from the group consisting of a ds DNA virus and a ssDNA virus.

Aspect H-58: NANOBODY® ($V_{HH}$ sequence) according to aspect H-56, wherein said RNA virus is chosen from the group consisting of a dsRNA virus, a positive-sense ssRNA virus and a negative-sense ssRNA virus.

Aspect H-59: NANOBODY® ($V_{HH}$ sequence) according to aspect H-56, wherein said Reverse Transcriptase (RT) virus is chosen from the group consisting of a dsDNA-RT virus and a ssRNA-RT virus.

Aspect H-60: NANOBODY® ($V_{HH}$ sequence) according to any of aspects H-1 to H-55, wherein said virus belongs to a viral family chosen from the group consisting of Orthomyxoviridae, Paramyxoviridae, Filoviridae, Retroviridae, Coronaviridae, Togaviridae and Flaviviridae, Rhabdoviridae, Herpesviridae, Arenaviridae, Bornaviridae, Bunyaviridae, Hepadnaviridae and Poxviridae.

Aspect H-61: NANOBODY® ($V_{HH}$ sequence) according to aspect H-60, wherein said virus belongs to a viral genus chosen from the group consisting of Alphaviruses and Flaviviruses.

Aspect H-62: NANOBODY® ($V_{HH}$ sequence) according to any of aspects H-1 to H-61, wherein said NANOBODY® ($V_{HH}$ sequence) neutralizes said virus.

Aspect H-63: NANOBODY® ($V_{HH}$ sequence) according to any of aspects H-1 to H-62, wherein said NANOBODY® ($V_{HH}$ sequence) modulates the infectivity of said virus.

Aspect H-64: NANOBODY® ($V_{HH}$ sequence) according to aspect H-63, wherein said NANOBODY® ($V_{HH}$ sequence) inhibits and/or prevents the infectivity of said virus.

Aspect H-65: NANOBODY® ($V_{HH}$ sequence) according to any of aspects H-63 or H-64, wherein said NANOBODY® ($V_{HH}$ sequence) neutralizes said virus and/or modulates, inhibits and/or prevents the infectivity of said virus in the pre-entry stage.

Aspect H-66: NANOBODY® ($V_{HH}$ sequence) according to aspect H-65, wherein said NANOBODY® ($V_{HH}$ sequence) modulates, inhibits and/or prevents viral entry in a target host cell.

Aspect H-67: NANOBODY® ($V_{HH}$ sequence) according to any of aspects H-1 to H-66, wherein said NANOBODY® ($V_{HH}$ sequence) induces virion aggregation of said virus.

Aspect H-68: NANOBODY® ($V_{HH}$ sequence) according to any of aspects H-1 to H-67, wherein said NANOBODY® ($V_{HH}$ sequence) destabilizes the virion structure of said virus.

Aspect H-69: NANOBODY® ($V_{HH}$ sequence) according to any of aspects H-1 to H-68, wherein said NANOBODY® ($V_{HH}$ sequence) inhibits virion attachment to a target host cell of said virus.

Aspect H-70: NANOBODY® ($V_{HH}$ sequence) according to aspect H-69, wherein said NANOBODY® ($V_{HH}$ sequence) inhibits virion attachment to a target host cell of said virus by modulating the interaction between said envelope protein and a viral receptor.

Aspect H-71: NANOBODY® ($V_{HH}$ sequence) according to aspects H-69 or H-70, wherein said NANOBODY® ($V_{HH}$ sequence) inhibits virion attachment to a target host cell of said virus by inhibiting and/or preventing the interaction between said envelope protein and a viral receptor.

Aspect H-72: NANOBODY® ($V_{HH}$ sequence) according to aspects H-69 to H-71, wherein said NANOBODY® ($V_{HH}$ sequence) competes with said envelope protein for binding to a viral receptor.

Aspect H-73: NANOBODY® ($V_{HH}$ sequence) according to any of aspects H-1 to H-72, wherein said NANOBODY® ($V_{HH}$ sequence) inhibits fusion of said virus with a target host cell of said virus.

Aspect H-74: NANOBODY® ($V_{HH}$ sequence) according to aspect H-73, wherein fusion of said virus with a target host cell of said virus taking place at the target host cell membrane is inhibited.

Aspect H-75: NANOBODY® ($V_{HH}$ sequence) according to aspect H-73, wherein fusion of said virus with a target host cell of said virus taking place within an endosomal or lysosomal compartment is inhibited.

Aspect H-76: NANOBODY® ($V_{HH}$ sequence) according to any of aspects H-73 to H-75, wherein said NANOBODY® ($V_{HH}$ sequence) prevents said envelope protein of a virus from undergoing a conformational change.

Aspect H-77: NANOBODY® ($V_{HH}$ sequence) according to any of aspects H-63 or H-64, wherein said NANOBODY® ($V_{HH}$ sequence) neutralizes said virus and/or modulates, inhibits and/or prevents the infectivity of said virus in the post-entry stage.

Aspect H-78: NANOBODY® ($V_{HH}$ sequence) according to any of aspects H-1 to H-77, wherein said NANOBODY® ($V_{HH}$ sequence) modulates, inhibits and/or prevents viral replication in a target host cell.

Aspect H-79: NANOBODY® ($V_{HH}$ sequence) according to any of aspects H-1 to H-78, wherein said NANOBODY® ($V_{HH}$ sequence) affects, inhibits and/or prevents transcription and/or translation of the viral genome.

Aspect H-80: NANOBODY® ($V_{HH}$ sequence) according to any of aspects H-1 to H-79, wherein said NANOBODY® ($V_{HH}$ sequence) affects, inhibits and/or prevents viral packaging and/or the formation of functional virions.

Aspect H-81: NANOBODY® ($V_{HH}$ sequence) according to any of aspects H-1 to H-80, wherein said NANOBODY® ($V_{HH}$ sequence) reduces, inhibits and/or prevents budding or release of nascent virions from a target host cell surface.

Aspect H-82: NANOBODY® ($V_{HH}$ sequence) according to any of aspects H-1 to H-81, wherein said NANOBODY® ($V_{HH}$ sequence) is directed against and/or can specifically bind to at least two epitopes of an envelope protein of a virus.

Aspect H-83: NANOBODY® ($V_{HH}$ sequence) according to aspect H-82, wherein said NANOBODY® ($V_{HH}$ sequence) is directed against and/or can specifically bind to at least two epitopes of one envelope protein of a virus.

Aspect H-84: NANOBODY® ($V_{HH}$ sequence) according to any of aspects H-1 to H-82, wherein said NANOBODY® ($V_{HH}$ sequence) is directed against and/or can specifically bind to at least two epitopes of at least two envelope proteins of a virus.

Aspect H-85: NANOBODY® ($V_{HH}$ sequence) according to any of aspects H-1 to H-82 and H-84, wherein said NANOBODY® ($V_{HH}$ sequence) is directed against and/or can specifically bind to three or more epitopes of said envelope protein of a virus.

Aspect H-86: NANOBODY® ($V_{HH}$ sequence) according to aspect H-85, wherein said NANOBODY® ($V_{HH}$ sequence) is directed against and/or can specifically bind to three or more epitopes of at least two envelope proteins of a virus.

Aspect H-87: NANOBODY® ($V_{HH}$ sequence) according to any of aspects H-82 to H-86, wherein said at least two or three or more epitopes are the same or are different.

Aspect H-88: NANOBODY® ($V_{HH}$ sequence) according to any of aspects H-84 or H-86, wherein said at least two envelope proteins are the same or are different.

Aspect H-89: NANOBODY® ($V_{HH}$ sequence) according to any of aspects H-1 to H-88, that is in essentially isolated form.

Aspect H-90: NANOBODY® ($V_{HH}$ sequence) according to any of aspects H-1 to H-89, that can specifically bind to an envelope protein of a virus with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter.

Aspect H-91: NANOBODY® ($V_{HH}$ sequence) according to any of aspects H-1 to H-90, that can specifically bind to an envelope protein of a virus with a rate of association ($k_{on}$-rate) of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$.

Aspect H-92: NANOBODY® ($V_{HH}$ sequence) according to any of aspects H-1 to H-91, that can specifically bind to an envelope protein of a virus with a rate of dissociation ($k_{off}$ rate) between 1 $s^{-1}$ and $10^{-6}$ $s^{-1}$ preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Aspect H-93: NANOBODY® ($V_{HH}$ sequence) according to any of aspects H-1 to H-92, that can specifically bind to an envelope protein of a virus with an affinity less than 500 nM, preferably less than 200 nM, more preferably less than 10 nM, such as less than 500 pM.

Aspect H-94: NANOBODY® ($V_{HH}$ sequence) according to any of aspects H-1 to H-93, that is a naturally occurring NANOBODY® ($V_{HH}$ sequence) (from any suitable species) or a synthetic or semi-synthetic NANOBODY® ($V_{HH}$ sequence).

Aspect H-95: NANOBODY® ($V_{HH}$ sequence) according to any of aspects H-1 to H-94, that is a $V_{HH}$ sequence, a partially humanized $V_{HH}$ sequence, a fully humanized $V_{HH}$ sequence, a camelized heavy chain variable domain or a NANOBODY® ($V_{HH}$ sequence) that has been obtained by techniques such as affinity maturation.

Aspect H-96: NANOBODY® ($V_{HH}$ sequence) according to any of aspects H-1 to H-95, that a. has at least 80% amino acid identity with at least one of the amino acid sequences of SEQ ID NO's: 1 to 22, in which for the purposes of determining the degree of amino acid identity, the amino acid residues that form the CDR sequences are disregarded;

and in which:

b. preferably one or more of the amino acid residues at positions 11, 37, 44, 45, 47, 83, 84, 103, 104 and 108 according to the Kabat numbering are chosen from the Hallmark residues mentioned in Table B-2.

Aspect H-97: NANOBODY® ($V_{HH}$ sequence) according to any of aspects H-1 to H-96, that a. has at least 80% amino acid identity with at least one of the amino acid sequences of SEQ ID NO's: 126 to 407, 2431 to 2448, 2574 to 2581, 2682 to 2717 and 3064 to 3128, in which for the purposes of determining the degree of amino acid identity, the amino acid residues that form the CDR sequences are disregarded;

and in which:

b. preferably one or more of the amino acid residues at positions 11, 37, 44, 45, 47, 83, 84, 103, 104 and 108 according to the Kabat numbering are chosen from the Hallmark residues mentioned in Table B-2.

Aspect H-98: NANOBODY® ($V_{HH}$ sequence) according to any of aspects H-1 to H-97, in which:

CDR1 is chosen from the group consisting of:

a. the amino acid sequences of SEQ ID NO's: 690 to 971, 2467 to 2484, 2590 to 2597, 2754 to 2789 and 3194 to 3258;

b. amino acid sequences that have at least 80% amino acid identity with at least one of the amino acid sequences of SEQ ID NO's: 690 to 971, 2467 to 2484, 2590 to 2597, 2754 to 2789 and 3194 to 3258;

c. amino acid sequences that have 3, 2, or 1 amino acid difference with at least one of the amino acid sequences of SEQ ID NO's: 690 to 971, 2467 to 2484, 2590 to 2597, 2754 to 2789 and 3194 to 3258;

and/or

CDR2 is chosen from the group consisting of:

d. the amino acid sequences of SEQ ID NO's: 1254 to 1535, 2503 to 2520, 2606 to 2613, 2826 to 2861 and 3324 to 3388;

e. amino acid sequences that have at least 80% amino acid identity with at least one of the amino acid sequences of SEQ ID NO's: 1254 to 1535, 2503 to 2520, 2606 to 2613, 2826 to 2861 and 3324 to 3388;

f. amino acid sequences that have 3, 2, or 1 amino acid difference with at least one of the amino acid sequences of SEQ ID NO's: 1254 to 1535, 2503 to 2520, 2606 to 2613, 2826 to 2861 and 3324 to 3388;

and/or

CDR3 is chosen from the group consisting of:

g. the amino acid sequences of SEQ ID NO's: 1818 to 2099, 2539 to 2556, 2622 to 2629, 2898 to 2933 and 3454 to 3518;

h. amino acid sequences that have at least 80% amino acid identity with at least one of the amino acid sequences of SEQ ID NO's: 1818 to 2099, 2539 to 2556, 2622 to 2629, 2898 to 2933 and 3454 to 3518;

i. amino acid sequences that have 3, 2, or 1 amino acid difference with at least one of the amino acid sequences of SEQ ID NO's: 1818 to 2099, 2539 to 2556, 2622 to 2629, 2898 to 2933 and 3454 to 3518.

Aspect H-99: NANOBODY® ($V_{HH}$ sequence) according to any of aspects H-1 to H-98, in which:

CDR1 is chosen from the group consisting of:

a. the amino acid sequences of SEQ ID NO's: 690 to 971, 2467 to 2484, 2590 to 2597, 2754 to 2789 and 3194 to 3258;

b. amino acid sequences that have at least 80% amino acid identity with at least one of the amino acid sequences of SEQ ID NO's: 690 to 971, 2467 to 2484, 2590 to 2597, 2754 to 2789 and 3194 to 3258;

c. amino acid sequences that have 3, 2, or 1 amino acid difference with at least one of the amino acid sequences of SEQ ID NO's: 690 to 971, 2467 to 2484, 2590 to 2597, 2754 to 2789 and 3194 to 3258;

and

CDR2 is chosen from the group consisting of:

d. the amino acid sequences of SEQ ID NO's: 1254 to 1535, 2503 to 2520, 2606 to 2613, 2826 to 2861 and 3324 to 3388;

e. amino acid sequences that have at least 80% amino acid identity with at least one of the amino acid sequences of SEQ ID NO's: 1254 to 1535, 2503 to 2520, 2606 to 2613, 2826 to 2861 and 3324 to 3388;

f. amino acid sequences that have 3, 2, or 1 amino acid difference with at least one of the amino acid sequences of SEQ ID NO's: 1254 to 1535, 2503 to 2520, 2606 to 2613, 2826 to 2861 and 3324 to 3388;

and

CDR3 is chosen from the group consisting of:

g. the amino acid sequences of SEQ ID NO's: 1818 to 2099, 2539 to 2556, 2622 to 2629, 2898 to 2933 and 3454 to 3518;

h. amino acid sequences that have at least 80% amino acid identity with at least one of the amino acid sequences of SEQ ID NO's: 1818 to 2099, 2539 to 2556, 2622 to 2629, 2898 to 2933 and 3454 to 3518;

i. amino acid sequences that have 3, 2, or 1 amino acid difference with at least one of the amino acid sequences of SEQ ID NO's: 1818 to 2099, 2539 to 2556, 2622 to 2629, 2898 to 2933 and 3454 to 3518.

Aspect H-100:NANOBODY® ($V_{HH}$ sequence) according to any of aspects H-1 to H-99, in which the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 126 to 407, 2431 to 2448, 2574 to 2581, 2682 to 2717 and 3064 to 3128.

Aspect H-101:NANOBODY® ($V_{HH}$ sequence) according to any of aspects H-1 to H-100, which is a partially humanized NANOBODY® ($V_{HH}$ sequence).

Aspect H-102:NANOBODY® ($V_{HH}$ sequence) according to any of aspects H-1 to H-101, which is a fully humanized NANOBODY® ($V_{HH}$ sequence).

Aspect H-103:NANOBODY® ($V_{HH}$ sequence) according to any of aspects H-1 to H-102 that is chosen from the group consisting of SEQ ID NO's: 126 to 407, 2431 to 2448, 2574 to 2581, 2682 to 2717 and 3064 to 3128 or from the group consisting of from amino acid sequences that have more than 80%, preferably more than 90%, more preferably more than 95%, such as 99% or more sequence identity (as defined herein) with at least one of the amino acid sequences of SEQ ID NO's: 126 to 407, 2431 to 2448, 2574 to 2581, 2682 to 2717 and 3064 to 3128.

Aspect H-104:NANOBODY® ($V_{HH}$ sequence) directed against an envelope protein of a virus that cross-blocks the binding of at least one of the amino acid sequences of SEQ ID NO's: 126 to 407, 2431 to 2448, 2574 to 2581, 2682 to 2717 and 3064 to 3128 to an envelope protein of a virus.

Aspect H-105:NANOBODY® ($V_{HH}$ sequence) directed against an envelope protein of a virus that is cross-blocked from binding to an envelope protein of a virus by at least one of the amino acid sequences of SEQ ID NO's: 126 to 407, 2431 to 2448, 2574 to 2581, 2682 to 2717 and 3064 to 3128.

Aspect H-106:NANOBODY® ($V_{HH}$ sequence) according to any of aspects H-104 or H-105, wherein the ability of said NANOBODY® ($V_{HH}$ sequence) to cross-block or to be cross-blocked is detected in a Biacore assay.

Aspect H-107:NANOBODY® ($V_{HH}$ sequence) according to any of aspects H-104 or H-105, wherein the ability of said NANOBODY® ($V_{HH}$ sequence) to cross-block or to be cross-blocked is detected in an ELISA assay.

Aspect H-108:NANOBODY® ($V_{HH}$ sequence) according to any of aspects H-1 to H-107, in which:

CDR1 is chosen from the group consisting of:

a. the amino acid sequences of SEQ ID NO's: 722 to 800, 812 to 971, 2484 and 2590 to 2597;

b. amino acid sequences that have at least 80% amino acid identity with at least one of the amino acid sequences of SEQ ID NO's: 722 to 800, 812 to 971, 2484 and 2590 to 2597;

c. amino acid sequences that have 3, 2, or 1 amino acid difference with at least one of the amino acid sequences of SEQ ID NO's: 722 to 800, 812 to 971, 2484 and 2590 to 2597;

and/or

CDR2 is chosen from the group consisting of:

d. the amino acid sequences of SEQ ID NO's: 1286 to 1364, 1376 to 1535, 2520 and 2606 to 2613;

e. amino acid sequences that have at least 80% amino acid identity with at least one of the amino acid sequences of SEQ ID NO's: 1286 to 1364, 1376 to 1535, 2520 and 2606 to 2613;

f. amino acid sequences that have 3, 2, or 1 amino acid difference with at least one of the amino acid sequences of SEQ ID NO's: 1286 to 1364, 1376 to 1535, 2520 and 2606 to 2613;

and/or

CDR3 is chosen from the group consisting of:

g. the amino acid sequences of SEQ ID NO's: 1850 to 1928, 1940 to 2099, 2556 and 2622 to 2629;

h. amino acid sequences that have at least 80% amino acid identity with at least one of the amino acid sequences of SEQ ID NO's: 1850 to 1928, 1940 to 2099, 2556 and 2622 to 2629;

i. amino acid sequences that have 3, 2, or 1 amino acid difference with at least one of the amino acid sequences of SEQ ID NO's: 1850 to 1928, 1940 to 2099, 2556 and 2622 to 2629.

Aspect H-109:NANOBODY® ($V_{HH}$ sequence) according to any of aspects H-1 to H-108, in which:

CDR1 is chosen from the group consisting of:

a. the amino acid sequences of SEQ ID NO's: 722 to 800, 812 to 971, 2484 and 2590 to 2597;

b. amino acid sequences that have at least 80% amino acid identity with at least one of the amino acid sequences of SEQ ID NO's: 722 to 800, 812 to 971, 2484 and 2590 to 2597;

c. amino acid sequences that have 3, 2, or 1 amino acid difference with at least one of the amino acid sequences of SEQ ID NO's: 722 to 800, 812 to 971, 2484 and 2590 to 2597;

and

CDR2 is chosen from the group consisting of:

d. the amino acid sequences of SEQ ID NO's: 1286 to 1364, 1376 to 1535, 2520 and 2606 to 2613;

e. amino acid sequences that have at least 80% amino acid identity with at least one of the amino acid sequences of SEQ ID NO's: 1286 to 1364, 1376 to 1535, 2520 and 2606 to 2613;

f. amino acid sequences that have 3, 2, or 1 amino acid difference with at least one of the amino acid sequences of SEQ ID NO's: 1286 to 1364, 1376 to 1535, 2520 and 2606 to 2613;

and

CDR3 is chosen from the group consisting of:

g. the amino acid sequences of SEQ ID NO's: 1850 to 1928, 1940 to 2099, 2556 and 2622 to 2629;

h. amino acid sequences that have at least 80% amino acid identity with at least one of the amino acid sequences of SEQ ID NO's: 1850 to 1928, 1940 to 2099, 2556 and 2622 to 2629;

i. amino acid sequences that have 3, 2, or 1 amino acid difference with at least one of the amino acid sequences of SEQ ID NO's: 1850 to 1928, 1940 to 2099, 2556 and 2622 to 2629.

Aspect H-110:NANOBODY® ($V_{HH}$ sequence) according to any of aspects H-1 to H-109, in which the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 158 to 236, 248 to 407, 2448 and 2574 to 2581.

Aspect H-111:NANOBODY® ($V_{HH}$ sequence) according to any of aspects H-1 to H-110, which is a partially humanized NANOBODY® ($V_{HH}$ sequence).

Aspect H-112:NANOBODY® ($V_{HH}$ sequence) according to any of aspects H-1 to H-111, which is a fully humanized NANOBODY® ($V_{HH}$ sequence).

Aspect H-113:NANOBODY® ($V_{HH}$ sequence) according to any of aspects H-1 to H-112, that is chosen from the group consisting of SEQ ID NO's: 158 to 236, 248 to 407, 2448 and 2574 to 2581 or from the group consisting of from amino acid sequences that have more than 80%, preferably more than 90%, more preferably more than 95%, such as 99% or more sequence identity (as defined herein) with at least one of the amino acid sequences of SEQ ID NO's: 158 to 236, 248 to 407, 2448 and 2574 to 2581.

Aspect H-114:NANOBODY® ($V_{HH}$ sequence) directed against at least one epitope of the F-protein of human RSV virus that cross-blocks the binding of at least one of the amino acid sequences of SEQ ID NO's: 158 to 236, 248 to 407, 2448 and 2574 to 2581 to at least one epitope of the F-protein of human RSV virus.

Aspect H-115:NANOBODY® ($V_{HH}$ sequence) directed against at least one epitope of the F-protein of human RSV virus that is cross-blocked from binding to an epitope of the F-protein of human RSV virus by at least one of the amino acid sequences of SEQ ID NO's: 158 to 236, 248 to 407, 2448 and 2574 to 2581.

Aspect H-116:NANOBODY® ($V_{HH}$ sequence) according to any of aspects H-114 or H-115, wherein the ability of said NANOBODY® ($V_{HH}$ sequence) to cross-block or to be cross-blocked is detected in a Biacore assay.

Aspect H-117:NANOBODY® ($V_{HH}$ sequence) according to any of aspects H-114 or H-115, wherein the ability of said NANOBODY® ($V_{HH}$ sequence) to cross-block or to be cross-blocked is detected in an ELISA assay.

Aspect H-118:NANOBODY® ($V_{HH}$ sequence) according to any of aspects H-1 to H-117, in which:

CDR1 is chosen from the group consisting of:

a. the amino acid sequences of SEQ ID NO's: 690 to 721, 2467 to 2483, 2754 to 2755 and 3194 to 3258;

b. amino acid sequences that have at least 80% amino acid identity with at least one of the amino acid sequences of SEQ ID NO's: 690 to 721, 2467 to 2483, 2754 to 2755 and 3194 to 3258;

c. amino acid sequences that have 3, 2, or 1 amino acid difference with at least one of the amino acid sequences of SEQ ID NO's: 690 to 721, 2467 to 2483, 2754 to 2755 and 3194 to 3258;

and/or

CDR2 is chosen from the group consisting of:

d. the amino acid sequences of SEQ ID NO's: 1254 to 1285, 2503 to 2519, 2826 to 2827 and 3324 to 3388;

e. amino acid sequences that have at least 80% amino acid identity with at least one of the amino acid sequences of SEQ ID NO's: 1254 to 1285, 2503 to 2519, 2826 to 2827 and 3324 to 3388;

f. amino acid sequences that have 3, 2, or 1 amino acid difference with at least one of the amino acid sequences of SEQ ID NO's: 1254 to 1285, 2503 to 2519, 2826 to 2827 and 3324 to 3388;

and/or

CDR3 is chosen from the group consisting of:

g. the amino acid sequences of SEQ ID NO's: 1818 to 1849, 2539 to 2555, 2898 to 2899 and 3454 to 3518;

h. amino acid sequences that have at least 80% amino acid identity with at least one of the amino acid sequences of SEQ ID NO's: 1818 to 1849, 2539 to 2555, 2898 to 2899 and 3454 to 3518;

i. amino acid sequences that have 3, 2, or 1 amino acid difference with at least one of the amino acid sequences of SEQ ID NO's: 1818 to 1849, 2539 to 2555, 2898 to 2899 and 3454 to 3518.

Aspect H-119:NANOBODY® ($V_{HH}$ sequence) according to any of aspects H-1 to H-118, in which:

CDR1 is chosen from the group consisting of:

a. the amino acid sequences of SEQ ID NO's: 690 to 721, 2467 to 2483, 2754 to 2755 and 3194 to 3258;

b. amino acid sequences that have at least 80% amino acid identity with at least one of the amino acid sequences of SEQ ID NO's: 690 to 721, 2467 to 2483, 2754 to 2755 and 3194 to 3258;

c. amino acid sequences that have 3, 2, or 1 amino acid difference with at least one of the amino acid sequences of SEQ ID NO's: 690 to 721, 2467 to 2483, 2754 to 2755 and 3194 to 3258;

and

CDR2 is chosen from the group consisting of:

d. the amino acid sequences of SEQ ID NO's: 1254 to 1285, 2503 to 2519, 2826 to 2827 and 3324 to 3388;

e. amino acid sequences that have at least 80% amino acid identity with at least one of the amino acid sequences of SEQ ID NO's: 1254 to 1285, 2503 to 2519, 2826 to 2827 and 3324 to 3388;

f. amino acid sequences that have 3, 2, or 1 amino acid difference with at least one of the amino acid sequences of SEQ ID NO's: 1254 to 1285, 2503 to 2519, 2826 to 2827 and 3324 to 3388;

and

CDR3 is chosen from the group consisting of:

g. the amino acid sequences of SEQ ID NO's: 1818 to 1849, 2539 to 2555, 2898 to 2899 and 3454 to 3518;

h. amino acid sequences that have at least 80% amino acid identity with at least one of the amino acid sequences of SEQ ID NO's: 1818 to 1849, 2539 to 2555, 2898 to 2899 and 3454 to 3518;

i. amino acid sequences that have 3, 2, or 1 amino acid difference with at least one of the amino acid sequences of SEQ ID NO's: 1818 to 1849, 2539 to 2555, 2898 to 2899 and 3454 to 3518.

Aspect H-120:NANOBODY® ($V_{HH}$ sequence) according to any of aspects H-1 to H-119, in which the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 126 to 157, 2431 to 2447, 2682 to 2683 and 3064 to 3128.

Aspect H-121:NANOBODY® ($V_{HH}$ sequence) according to any of aspects H-1 to H-120, which is a partially humanized NANOBODY® ($V_{HH}$ sequence).

Aspect H-122:NANOBODY® ($V_{HH}$ sequence) according to any of aspects H-1 to H-121, which is a fully humanized NANOBODY® ($V_{HH}$ sequence).

Aspect H-123:NANOBODY® ($V_{HH}$ sequence) according to any of aspects H-1 to H-122, that is chosen from the group consisting of SEQ ID NO's: 126 to 157, 2431 to 2447, 2682 to 2683 and 3064 to 3128 or from the group consisting of from amino acid sequences that have more than 80%, preferably more than 90%, more preferably more than 95%, such as 99% or more sequence identity (as defined herein) with at least one of the amino acid sequences of SEQ ID NO's: 126 to 157, 2431 to 2447, 2682 to 2683 and 3064 to 3128.

Aspect H-124:NANOBODY® ($V_{HH}$ sequence) directed against at least one epitope of hemagglutinin H5 protein of influenza virus that cross-blocks the binding of at least one of the amino acid sequences of SEQ ID NO's: 126 to 157, 2431 to 2447, 2682 to 2683 and 3064 to 3128 to at least one epitope of hemagglutinin H5 protein of influenza virus.

Aspect H-125:NANOBODY® ($V_{HH}$ sequence) directed against at least one epitope of hemagglutinin H5 protein of influenza virus that is cross-blocked from binding to at least one epitope of hemagglutinin H5 protein of influenza virus by at least one of the amino acid sequences of SEQ ID NO's: 126 to 157, 2431 to 2447, 2682 to 2683 and 3064 to 3128.

Aspect H-126:NANOBODY® ($V_{HH}$ sequence) according to any of aspects H-124 or H-125, wherein the ability of said NANOBODY® ($V_{HH}$ sequence) to cross-block or to be cross-blocked is detected in a Biacore assay.

Aspect H-127:NANOBODY® ($V_{HH}$ sequence) according to any of aspects H-124 or H-125, wherein the ability of said NANOBODY® ($V_{HH}$ sequence) to cross-block or to be cross-blocked is detected in an ELISA assay.

Aspect H-128:NANOBODY® ($V_{HH}$ sequence) according to any of aspects H-1 to H-127, in which:

CDR1 is chosen from the group consisting of:

a. the amino acid sequences of SEQ ID NO's: 801 to 811 and 2756 to 2789;

b. amino acid sequences that have at least 80% amino acid identity with at least one of the amino acid sequences of SEQ ID NO's: 801 to 811 and 2756 to 2789;

c. amino acid sequences that have 3, 2, or 1 amino acid difference with at least one of the amino acid sequences of SEQ ID NO's: 801 to 811 and 2756 to 2789;

and/or

CDR2 is chosen from the group consisting of:

d. the amino acid sequences of SEQ ID NO's: 1365 to 1375 and 2828 to 2861;

e. amino acid sequences that have at least 80% amino acid identity with at least one of the amino acid sequences of SEQ ID NO's: 1365 to 1375 and 2828 to 2861;

f. amino acid sequences that have 3, 2, or 1 amino acid difference with at least one of the amino acid sequences of SEQ ID NO's: 1365 to 1375 and 2828 to 2861;

and/or

CDR3 is chosen from the group consisting of:

g. the amino acid sequences of SEQ ID NO's: 1929 to 1939 and 2900 to 2933;

h. amino acid sequences that have at least 80% amino acid identity with at least one of the amino acid sequences of SEQ ID NO's: 1929 to 1939 and 2900 to 2933;

i. amino acid sequences that have 3, 2, or 1 amino acid difference with at least one of the amino acid sequences of SEQ ID NO's: 1929 to 1939 and 2900 to 2933.

Aspect H-129:NANOBODY® ($V_{HH}$ sequence) according to any of aspects H-1 to H-128, in which:

CDR1 is chosen from the group consisting of:

a. the amino acid sequences of SEQ ID NO's: 801 to 811 and 2756 to 2789;

b. amino acid sequences that have at least 80% amino acid identity with at least one of the amino acid sequences of SEQ ID NO's: 801 to 811 and 2756 to 2789;

c. amino acid sequences that have 3, 2, or 1 amino acid difference with at least one of the amino acid sequences of SEQ ID NO's: 801 to 811 and 2756 to 2789;

and

CDR2 is chosen from the group consisting of:

d. the amino acid sequences of SEQ ID NO's: 1365 to 1375 and 2828 to 2861;

e. amino acid sequences that have at least 80% amino acid identity with at least one of the amino acid sequences of SEQ ID NO's: 1365 to 1375 and 2828 to 2861;

f. amino acid sequences that have 3, 2, or 1 amino acid difference with at least one of the amino acid sequences of SEQ ID NO's: 1365 to 1375 and 2828 to 2861;

and

CDR3 is chosen from the group consisting of:

g. the amino acid sequences of SEQ ID NO's: 1929 to 1939 and 2900 to 2933;

h. amino acid sequences that have at least 80% amino acid identity with at least one of the amino acid sequences of SEQ ID NO's: 1929 to 1939 and 2900 to 2933;

i. amino acid sequences that have 3, 2, or 1 amino acid difference with at least one of the amino acid sequences of SEQ ID NO's: 1929 to 1939 and 2900 to 2933.

Aspect H-130:NANOBODY® ($V_{HH}$ sequence) according to any of aspects H-1 to H-129, in which the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 237 to 247 and 2684 to 2717.

Aspect H-131:NANOBODY® ($V_{HH}$ sequence) according to any of aspects H-1 to H-130, which is a partially humanized NANOBODY® ($V_{HH}$ sequence).

Aspect H-132:NANOBODY® ($V_{HH}$ sequence) according to any of aspects H-1 to H-131, which is a fully humanized NANOBODY® ($V_{HH}$ sequence).

Aspect H-133:NANOBODY® ($V_{HH}$ sequence) according to any of aspects H-1 to H-132, that is chosen from the group consisting of SEQ ID NO's: 237 to 247 and 2684 to 2717 or from the group consisting of from amino acid sequences that have more than 80%, preferably more than 90%, more preferably more than 95%, such as 99% or more sequence identity (as defined herein) with at least one of the amino acid sequences of SEQ ID NO's: 237 to 247 and 2684 to 2717.

Aspect H-134:NANOBODY® ($V_{HH}$ sequence) directed against at least one epitope of the G-protein of rabies virus that cross-blocks the binding of at least one of the amino acid sequences of SEQ ID NO's: 237 to 247 and 2684 to 2717 to at least one epitope of the G-protein of rabies virus.

Aspect H-135:NANOBODY® ($V_{HH}$ sequence) directed against at least one epitope of the G-protein of rabies virus that is cross-blocked from binding to at least one epitope of the G-protein of rabies virus by at least one of the amino acid sequences of SEQ ID NO's: 237 to 247 and 2684 to 2717.

Aspect H-136:NANOBODY® ($V_{HH}$ sequence) according to any of aspects H-134 or H-135, wherein the ability of said NANOBODY® ($V_{HH}$ sequence) to cross-block or to be cross-blocked is detected in a Biacore assay.

Aspect H-137:NANOBODY® ($V_{HH}$ sequence) according to any of aspects H-134 or H-135, wherein the ability of said NANOBODY® ($V_{HH}$ sequence) to cross-block or to be cross-blocked is detected in an ELISA assay.

Aspect K-1: Polypeptide that comprises or essentially consists of one or more amino acid sequences according to any of aspects A-1 to A-109, B-1 to B-28, C-1 to C-16, D-1 to D-6, E-1 to E-14 and/or F-1 to F-47 and/or one or more NANOBODIES® ($V_{HH}$ sequences) according to any of aspects H-1 to H-137, and optionally further comprises one or more other amino acid binding units, optionally linked via one or more peptidic linkers.

Aspect K-2: Polypeptide according to aspect K-1, in which said one or more other binding units are immunoglobulin sequences.

Aspect K-3: Polypeptide according to any of aspects K-1 or K-2, in which said one or more other binding units are chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or NANOBODIES® ($V_{HH}$ sequences).

Aspect K-4: Polypeptide according to any of aspects K-1 to K-3, in which said one or more amino acid sequences of the invention are immunoglobulin sequences.

Aspect K-5: Polypeptide according to any of aspects K-1 to K-4, in which said one or more amino acid sequences of the invention are chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or NANOBODIES® ($V_{HH}$ sequences).

Aspect K-6: Polypeptide according to any of aspects K-1 to K-5, that comprises or essentially consists of one or more NANOBODIES® ($V_{HH}$ sequences) according to any of aspects H-1 to H-137 and in which said one or more other binding units are NANOBODIES® ($V_{HH}$ sequences).

Aspect K-7: Polypeptide according to any of aspects K-1 to K-6, which is a multivalent construct.

Aspect K-8: Polypeptide according to any of aspects K-1 to K-7, which is a multiparatopic construct.

Aspect K-9: Polypeptide according to any of aspects K-1 to K-8, which is a multispecific construct.

Aspect K-10: Polypeptide according to any of aspects K-1 to K-9, which has an increased half-life, compared to the corresponding amino acid sequence according to any of aspects A-1 to A-109, B-1 to B-28, C-1 to C-16, D-1 to D-6, E-1 to E-14 and/or F-1 to F-47 per se or NANOBODY® ($V_{HH}$ sequence) according to any of aspects H-1 to H-137 per se, respectively.

Aspect K-11: Polypeptide according to aspect K-10, in which said one or more other binding units provide the polypeptide with increased half-life, compared to the corresponding amino acid sequence according to any of aspects A-1 to A-109, B-1 to B-28, C-1 to C-16, D-1 to D-6, E-1 to E-14 and/or F-1 to F-47 per se or NANOBODY® ($V_{HH}$ sequence) according to any of aspects H-1 to H-137 per se, respectively.

Aspect K-12: Polypeptide according to aspect K-10 or K-11, in which said one or more other binding units that provide the polypeptide with increased half-life is chosen from the group consisting of serum proteins or fragments thereof, binding units that can bind to serum proteins, an Fc portion, and small proteins or peptides that can bind to serum proteins.

Aspect K-13: Polypeptide according to aspect K-10 to K-12, in which said one or more other binding units that provide the polypeptide with increased half-life is chosen from the group consisting of human serum albumin or fragments thereof.

Aspect K-14: Polypeptide according to aspect K-10 to K-13, in which said one or more other binding units that provides the polypeptide with increased half-life are chosen from the group consisting of binding units that can bind to serum albumin (such as human serum albumin) or a serum immunoglobulin (such as IgG).

Aspect K-15: Polypeptide according to aspect K-10 to K-14, in which said one or more other binding units that provides the polypeptide with increased half-life are chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or NANOBODIES® ($V_{HH}$ sequences) that can bind to serum albumin (such as human serum albumin) or a serum immunoglobulin (such as IgG).

Aspect K-16: Polypeptide according to aspect K-10 to K-15, in which said one or more other binding units that provides the polypeptide with increased half-life is a NANOBODY® ($V_{HH}$ sequence) that can bind to serum albumin (such as human serum albumin) or a serum immunoglobulin (such as IgG).

Aspect K-17: Polypeptide according to any of aspects K-10 to K-16, that has a serum half-life that is at least 1.5 times, preferably at least 2 times, such as at least 5 times, for example at least 10 times or more than 20 times, greater than the half-life of the corresponding amino acid sequence according to any of aspects A-1 to A-109, B-1 to B-28, C-1 to C-16, D-1 to D-6, E-1 to E-14 and/or F-1 to F-47 per se or NANOBODY® ($V_{HH}$ sequence) according to any of aspects H-1 to H-137 per se, respectively.

Aspect K-18: Polypeptide according to any of aspects K-10 to K-17, that has a serum half-life that is increased with more than 1 hours, preferably more than 2 hours, more preferably more than 6 hours, such as more than 12 hours, or even more than 24, 48 or 72 hours, compared to the corresponding amino acid sequence according to any of aspects A-1 to A-109, B-1 to B-28, C-1 to C-16, D-1 to D-6, E-1 to E-14 and/or F-1 to F-47 per se or NANOBODY® ($V_{HH}$ sequence) according to any of aspects H-1 to H-137 per se, respectively.

Aspect K-19: Polypeptide according to any of aspects K-10 to K-18, that has a serum half-life in human of at least about 12 hours, preferably at least 24 hours, more preferably at least 48 hours, even more preferably at least 72 hours or more; for example, of at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).

Aspect L-1. Compound or construct, that comprises or essentially consists of one or more amino acid sequences according to any of aspects A-1 to A-109, B-1 to B-28, C-1 to C-16, D-1 to D-6, E-1 to E-14 and/or F-1 to F-47 and/or one or more NANOBODIES® ($V_{HH}$ sequences) according to any of aspects H-1 to H-137 and/or one or more polypeptides according to any of aspects K-1 to K-19, and optionally further comprises one or more other groups, residues, moieties or binding units, optionally linked via one or more linkers.

Aspect L-2. Compound or construct according to aspect L-1, in which said one or more other groups, residues, moieties or binding units are amino acid sequences.

Aspect L-3. Compound or construct according to any of aspects L-1 or L-2, in which said one or more linkers, if present, are one or more amino acid sequences.

Aspect L-4. Compound or construct according to any of aspects L-1 to L-3, in which said one or more other groups, residues, moieties or binding units are immunoglobulin sequences.

Aspect L-5. Compound or construct according to any of aspects L-1 to L-4, in which said one or more other groups, residues, moieties or binding units are chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or NANOBODIES® ($V_{HH}$ sequences).

Aspect L-6. Compound or construct according to any of aspects L-1 to L-5, in which said one or more amino acid sequences of the invention are immunoglobulin sequences.

Aspect L-7. Compound or construct according to any of aspects L-1 to L-6, in which said one or more amino acid sequences of the invention are chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or NANOBODIES® ($V_{HH}$ sequences).

Aspect L-8. Compound or construct according to any of aspects L-1 to L-7, that comprises or essentially consists of one or more NANOBODIES® ($V_{HH}$ sequences) according to any of aspects H-1 to H-137, and in which said one or more other groups, residues, moieties or binding units are NANOBODIES® ($V_{HH}$ sequences).

Aspect L-9. Compound or construct according to any of aspects L-1 to L-8, which is a multivalent construct.

Aspect L-10. Compound or construct according to aspect L-9, which is a bivalent construct.

Aspect L-11. Compound or construct according to aspect L-10, which comprises two amino acid sequences that are directed against and/or capable of binding to the Synagis® binding site on the F protein of RSV.

Aspect L-12. Compound or construct according to any of aspects L-10 to L11, which comprises two amino acid sequences that are capable of competing with Synagis® for binding to the F protein of RSV.

Aspect L-13. Compound or construct according to aspect L-11, which comprises two amino acid sequences that are directed against and/or capable of binding antigenic site II of the F protein of RSV.

Aspect L-14. Compound or construct according to aspect L-11, which comprises two amino acid sequences that are directed against and/or capable of binding amino acid residues 250-275 of the F protein of RSV.

Aspect L-15. Compound or construct according to any of aspects L-10 to L-14 which can simultaneously bind both binding sites on the F protein of RSV.

Aspect L-16. Compound or construct according to any of aspects L-10 to L-15 which neutralizes RSV via the same mechanism as Synagis®.

Aspect L-17. Compound or construct according to aspect L-10, which comprises two amino acid sequences that are directed against and/or capable of binding to the 101F binding site on the F protein of RSV.

Aspect L-18. Compound or construct according to any of aspects L-10 or L-17, which comprises two amino acid sequences that are capable of competing with 101F for binding to the F protein of RSV.

Aspect L-19. Compound or construct according to aspect L-17, which comprises two amino acid sequences that are directed against and/or capable of binding antigenic site IV-VI of the F protein of RSV.

Aspect L-20. Compound or construct according to aspect L-17, which comprises two amino acid sequences that are directed against and/or capable of binding amino acid residues 423-436 of the F protein of RSV.

Aspect L-21. Compound or construct according to any of aspects L-17 to L-20 which can simultaneously bind both binding sites on the F protein of RSV.

Aspect L-22. Compound or construct according to any of aspects L-17 to L-21 which neutralizes RSV via the same mechanism as 101F.

Aspect L-23. Compound or construct according to aspect L-10, which comprises two amino acid sequences that are directed against and/or capable of binding to the sialic acid binding site on the hemagglutinin H5 envelope protein of influenza virus.

Aspect L-24. Compound or construct according to any of aspects L-10 or L-23, which comprises two amino acid sequences that are capable of competing with sialic acid for binding to the hemagglutinin H5 envelope protein of influenza virus.

Aspect L-25. Compound or construct according to any of aspects L-23 or L-24, which can simultaneously bind both binding sites on the hemagglutinin H5 envelope protein of influenza virus.

Aspect L-26. Compound or construct according to aspect L-10, which comprises two amino acid sequences that are directed against and/or capable of binding to the VN04-2 binding site on the hemagglutinin H5 envelope protein of influenza virus.

Aspect L-27. Compound or construct according to any of aspects L-10 or L-26, which comprises two amino acid sequences that are capable of competing with VN04-2 for binding to the hemagglutinin H5 envelope protein of influenza virus.

Aspect L-28. Compound or construct according to any of aspects L-26 or L-27, which can simultaneously bind both binding sites on the hemagglutinin H5 envelope protein of influenza virus.

Aspect L-29. Compound or construct according to any of aspects L-26 to L-28 which neutralizes RSV via the same mechanism as VN04-2.

Aspect L-30. Compound or construct according to aspect L-10, which comprises two amino acid sequences that are directed against and/or capable of binding to the MAb C179 binding site on the hemagglutinin H5 envelope protein of influenza virus.

Aspect L-31. Compound or construct according to any of aspects L-10 or L-30, which comprises two amino acid sequences that are capable of competing with MAb C179 for binding to the hemagglutinin H5 envelope protein of influenza virus.

Aspect L-32. Compound or construct according to any of aspects L-30 or L-31, which can simultaneously bind both binding sites on the hemagglutinin H5 envelope protein of influenza virus.

Aspect L-33. Compound or construct according to any of aspects L-30 to L-32 which neutralizes RSV via the same mechanism as MAb C179.

Aspect L-34. Compound or construct according to aspect L-10, which comprises two amino acid sequences that are directed against and/or capable of binding to the MAb 8-2 binding site on the G envelope protein of rabies virus.

Aspect L-35. Compound or construct according to any of aspects L-10 or L-34, which comprises two amino acid sequences that are capable of competing with the MAb 8-2 for binding to the G envelope protein of rabies virus.

Aspect L-36. Compound or construct according to any of aspects L-34 or L-35, which can simultaneously bind both binding sites on the G envelope protein of rabies virus.

Aspect L-37. Compound or construct according to any of aspects L-34 to L-36 which neutralizes RSV via the same mechanism as MAb 8-2.

Aspect L-38. Compound or construct according to aspect L-9, which is a biparatopic construct.

Aspect L-39. Compound or construct according to any of aspects L-38, which comprises at least one amino acid sequence directed against a first antigenic determinant, epitope, part or domain of an envelope protein of a virus and at least one amino acid sequence directed against a second antigenic determinant, epitope, part or domain of the envelope protein of a virus different from the first antigenic determinant, epitope, part or domain.

Aspect L-40. Biparatopic compound or construct according to aspect L-39, which is capable of simultaneously binding to said first antigenic determinant, epitope, part or domain of an envelope protein of a virus and to said second antigenic determinant, epitope, part or domain of the envelope protein of a virus.

Aspect L-41. Compound or construct according to any of aspects L-38 to L-40, which combines two or more different modes of action each mediated by one of its binding units, wherein each binding unit binds at a different binding site of an envelope protein of a virus.

Aspect L-42. Compound or construct according to any of aspects L-38 to L-41, which comprises at least one amino acid sequence directed against a first antigenic determinant, epitope, part or domain of the F protein of RSV virus and at least one amino acid sequence directed against a second antigenic determinant, epitope, part or domain of the F protein of RSV virus different from the first antigenic determinant, epitope, part or domain.

Aspect L-43. Biparatopic compound or construct according to aspect L-42, which is capable of simultaneously binding to said first antigenic determinant, epitope, part or domain of the F protein of RSV virus and to said second antigenic determinant, epitope, part or domain of the F protein of RSV virus.

Aspect L-44. Compound or construct according to any of aspects L-38 to L-43, which combines two or more different modes of action each mediated by one of its binding units, wherein each binding unit binds at a different binding site of the F protein of RSV virus.

Aspect L-45. Compound or construct according to any of aspects L-42 to L-44 wherein said compound or construct competes with Synagis® for binding to the F protein of RSV virus.

Aspect L-46. Compound or construct according to aspects L-45, wherein said compound or construct inhibits and/or blocks binding of Synagis® to the F protein of RSV virus.

Aspect L-47. Compound or construct according to any of aspects L-45 to L-46, wherein said compound or construct is directed against the Synagis binding site on the F protein of RSV virus.

Aspect L-48. Compound or construct according to any of aspects L-45 to L-47, wherein said compound or construct specifically binds to antigenic site II of the F protein of RSV.

Aspect L-49. Compound or construct according to any of aspects L-45 to L-48, wherein said compound or construct specifically binds to at least one of amino acid residues 250-275 of the F protein of RSV.

Aspect L-50. Compound or construct according to any of aspects L-45 to L-49, which comprises at least one amino acid sequence that is directed against and/or capable of binding to the Synagis® binding site on the F protein of RSV and at least one further amino acid sequence that is capable of binding to at least one other antigenic determinant, epitope, part or domain of the F protein of RSV.

Aspect L-51. Compound or construct according to any of aspects L-45 to L-50, which comprises at least one amino acid sequence that is capable of competing with Synagis® for binding to the F protein of RSV and at least one further amino acid sequence that is capable of binding to at least one other antigenic determinant, epitope, part or domain of the F protein of RSV.

Aspect L-52. Compound or construct according to any of aspects L-45 to L-51, which comprises at least one amino acid sequence that is directed against and/or capable of binding antigenic site II of the F protein of RSV and at least one further amino acid sequence that is capable of binding to at least one other antigenic determinant, epitope, part or domain of the F protein of RSV.

Aspect L-53. Compound or construct according to any of aspects L-45 to L-52, which comprises at least one amino acid sequence that is directed against and/or capable of binding amino acid residues 250-275 of the F protein of RSV and at least one further amino acid sequence that is capable of binding to at least one other antigenic determinant, epitope, part or domain of the F protein of RSV.

Aspect L-54. Compound or construct according to any of aspects L-45 to L-53, which can simultaneously bind both binding sites on the F protein of RSV.

Aspect L-55. Compound or construct according to any of aspects L-45 to L-54, which neutralizes RSV via the same mechanism as Synagis®.

Aspect L-56. Compound or construct according to any of aspects L-42 to L-44 wherein said compound or construct competes with 101F for binding to the F protein of RSV virus.

Aspect L-57. Compound or construct according to aspect L-56, wherein said compound or construct inhibits and/or blocks binding of 101F to the F protein of RSV virus.

Aspect L-58. Compound or construct according to any of aspects L-56 to L-57, wherein said compound or construct is directed against the 101F binding site on the F protein of RSV virus.

Aspect L-59. Compound or construct according to any of aspects L-56 to L-58, wherein said compound or construct specifically binds to antigenic site IV-VI of the F protein of RSV.

Aspect L-60. Compound or construct according to any of aspects L-56 to L-59, wherein said compound or construct specifically binds to at least one of amino acid residues 423-436 of the F protein of RSV.

Aspect L-61. Compound or construct according to any of aspects L-56 to L-60, which comprises at least one amino acid sequence that is directed against and/or capable of binding to the 101F binding site on the F protein of RSV and at least one further amino acid sequence that is capable of binding to at least one other antigenic determinant, epitope, part or domain of the F protein of RSV.

Aspect L-62. Compound or construct according to any of aspects L-56 to L-61, which comprises at least one amino acid sequence that is capable of competing with 101F for binding to the F protein of RSV and at least one further amino acid sequence that is capable of binding to at least one other antigenic determinant, epitope, part or domain of the F protein of RSV.

Aspect L-63. Compound or construct according to any of aspects L-56 to L-62, which comprises at least one amino acid sequence that is directed against and/or capable of binding antigenic site IV-VI of the F protein of RSV and at least one further amino acid sequence that is capable of binding to at least one other antigenic determinant, epitope, part or domain of the F protein of RSV.

Aspect L-64. Compound or construct according to any of aspects L-56 to L-63, which comprises at least one amino acid sequence that is directed against and/or capable of binding amino acid residues 423-436 of the F protein of RSV and at least one further amino acid sequence that is capable of binding to at least one other antigenic determinant, epitope, part or domain of the F protein of RSV.

Aspect L-65. Compound or construct according to any of aspects L-56 to L-64, which can simultaneously bind both binding sites on the F protein of RSV.

Aspect L-66. Compound or construct according to any of aspects L-56 to L-65, which neutralizes RSV via the same mechanism as 101F.

Aspect L-67. Compound or construct according to any of aspects L-38 to L-66, wherein said compound or construct is directed against the Synagis® binding site on the F protein of RSV virus and against the 101F binding site on the F protein of RSV virus.

Aspect L-68. Compound or construct according to any of aspects L-38 to L-67, wherein said compound or construct competes with Synagis® and 101F for binding to the F protein of RSV virus.

Aspect L-69. Compound or construct according to any of aspects L-38 to L-68, wherein said compound or construct inhibits and/or blocks binding of Synagis® and 101F to the F protein of RSV virus.

Aspect L-70. Compound or construct according to any of aspects L-38 to L-69, which specifically binds the Synagis® binding site on the F protein of RSV virus and to the 101F binding site on the F protein of RSV virus.

Aspect L-71. Compound or construct according to any of aspects L-38 to L-70, which specifically binds to antigenic site II of the F protein of RSV virus.

Aspect L-72. Compound or construct according to any of aspects L-38 to L-71, which specifically binds to amino acid residues 250-275 of the F protein of RSV virus.

Aspect L-73. Compound or construct according to any of aspects L-38 to L-72, which specifically binds to antigenic site IV-VI of the F protein of RSV virus.

Aspect L-74. Compound or construct according to any of aspects L-38 to L-73, which specifically binds to at least one of amino acid residues 423-436 of the F protein of RSV virus.

Aspect L-75. Compound or construct according to any of aspects L-38 to L-74, which specifically binds to antigenic site II of the F protein of RSV virus and antigenic site IV-VI of the F protein of RSV virus.

Aspect L-76. Compound or construct according to any of aspects L-38 to L-75, which specifically binds to amino acid residues 250-275 of the F protein of RSV virus and amino acid residues 423-436 of the F protein of RSV virus.

Aspect L-77. Compound or construct according to any of aspects L-38 to L-76, which comprises at least one amino acid sequence that is directed against and/or capable of binding to the Synagis® binding site on the F protein of RSV and at least one further amino acid sequence that is directed against the 101F binding site on the F protein of RSV.

Aspect L-78. Compound or construct according to any of aspects L-38 to L-77, which comprises at least one amino acid sequence that is capable of competing with Synagis® for binding to the F protein of RSV and at least one further amino acid sequence that is capable of competing with 101F for binding to the F protein of RSV.

Aspect L-79. Compound or construct according to any of aspects L-38 to L-78, which comprises at least one amino acid sequence that is directed against and/or capable of binding antigenic site II of the F protein of RSV and at least one further amino acid sequence that is directed against and/or capable of binding antigenic site IV-VI of the F protein of RSV.

Aspect L-80. Compound or construct according to any of aspects L-38 to L-79, which comprises at least one amino acid sequence that is directed against and/or capable of binding amino acid residues 250-275 of the F protein of RSV and at least one amino acid sequence that is directed against and/or capable of binding amino acid residues 423-436 of the F protein of RSV.

Aspect L-81. Biparatopic compound or construct according to any of aspects L-38 to L-80, which can simultaneously bind the Synagis® binding site on the F protein of RSV and to the 101F binding site on the F protein of RSV.

Aspect L-82. Compound or construct according to any of aspects L-38 to L-81, that neutralizes RSV virus via the same mechanisms of actions as Synagis® and 101F.

Aspect L-83. Compound or construct according to aspect L-38, wherein both paratopes are directed against the Synagis® binding site on the F protein of RSV.

Aspect L-84. Compound or construct according to aspect L-83, wherein at least one paratope is directed against antigenic site II of the F protein of RSV.

Aspect L-85. Compound or construct according to aspect L-83, wherein at least one paratope is directed against amino acid residues 250-275 of the F protein of RSV.

Aspect L-86. Biparatopic compound or construct according to any of aspects L-83 to L-85, which can simultaneously bind both binding site on the F protein of RSV.

Aspect L-87. Compound or construct according to aspect L-38, wherein both paratopes are directed against the 101F binding site on the F protein of RSV.

Aspect L-88. Compound or construct according to aspect L-87, wherein at least one paratope is directed against antigenic site IV-VI of the F protein of RSV.

Aspect L-89. Compound or construct according to aspect L-87, wherein at least one paratope is directed against amino acid residues 423-436 of the F protein of RSV.

Aspect L-90. Biparatopic compound or construct according to any of aspects L-87 to L-89, which can simultaneously bind both binding site on the F protein of RSV.

Aspect L-91. Compound or construct according to any of aspects L-38 to L-41, which comprises at least one amino acid sequence directed against a first antigenic determinant, epitope, part or domain of the hemagglutinin H5 envelope protein of influenza virus and at least one amino acid sequence directed against a second antigenic determinant, epitope, part or domain of the hemagglutinin H5 envelope protein of influenza virus different from the first antigenic determinant, epitope, part or domain.

Aspect L-92. Biparatopic compound or construct according to aspect L-91, which is capable of simultaneously binding to said first antigenic determinant, epitope, part or domain of the hemagglutinin H5 envelope protein of influenza virus and to said second antigenic determinant, epitope, part or domain of the hemagglutinin H5 envelope protein of influenza virus.

Aspect L-93. Compound or construct according to any of aspects L-91 to L-92, which combines two or more different modes of action each mediated by one of its binding units, wherein each binding unit binds at a different binding site of the hemagglutinin H5 envelope protein of influenza virus.

Aspect L-94. Compound or construct according to any of aspects L-91 to L-93 wherein said compound or construct competes with sialic acid for binding to the hemagglutinin H5 envelope protein of influenza virus.

Aspect L-95. Compound or construct according to aspects L-94, wherein said compound or construct inhibits and/or blocks binding of sialic acid to the hemagglutinin H5 envelope protein of influenza virus.

Aspect L-96. Compound or construct according to any of aspects L-94 to L-95, wherein said compound or construct is directed against the sialic acid binding site on the hemagglutinin H5 envelope protein of influenza virus.

Aspect L-97. Compound or construct according to any of aspects L-94 to L-96, which comprises at least one amino acid sequence that is directed against and/or capable of binding to the sialic acid binding site on the hemagglutinin H5 envelope protein of influenza virus and at least one further amino acid sequence that is capable of binding to at least one other antigenic determinant, epitope, part or domain of the hemagglutinin H5 envelope protein of influenza virus.

Aspect L-98. Compound or construct according to any of aspects L-94 to L-97, which comprises at least one amino acid sequence that is capable of competing with sialic acid for binding to the hemagglutinin H5 envelope protein of influenza virus and at least one further amino acid sequence that is capable of binding to at least one other antigenic determinant, epitope, part or domain of the hemagglutinin H5 envelope protein of influenza virus.

Aspect L-99. Compound or construct according to any of aspects L-94 to L-98, which can simultaneously bind both binding sites on the hemagglutinin H5 envelope protein of influenza virus.

Aspect L-100. Compound or construct according to any of aspects L-91 to L-93 wherein said compound or construct competes with VN04-2 for binding to the hemagglutinin H5 envelope protein of influenza virus.

Aspect L-101. Compound or construct according to aspects L-100, wherein said compound or construct inhibits and/or blocks binding of VN04-2 to the hemagglutinin H5 envelope protein of influenza virus.

Aspect L-102. Compound or construct according to any of aspects L-100 to L-101, wherein said compound or construct is directed against the VN04-2 binding site on the hemagglutinin H5 envelope protein of influenza virus.

Aspect L-103. Compound or construct according to any of aspects L-100 to L-102, which comprises at least one amino acid sequence that is directed against and/or capable of binding to the VN04-2 binding site on the hemagglutinin H5 envelope protein of influenza virus and at least one further amino acid sequence that is capable of binding to at least one other antigenic determinant, epitope, part or domain of the hemagglutinin H5 envelope protein of influenza virus.

Aspect L-104. Compound or construct according to any of aspects L-100 to L-103, which comprises at least one amino acid sequence that is capable of competing with VN04-2 for binding to the hemagglutinin H5 envelope protein of influenza virus and at least one further amino acid sequence that is capable of binding to at least one other antigenic determinant, epitope, part or domain of the hemagglutinin H5 envelope protein of influenza virus.

Aspect L-105. Compound or construct according to any of aspects L-100 to L-104, which can simultaneously bind both binding sites on the hemagglutinin H5 envelope protein of influenza virus.

Aspect L-106. Compound or construct according to any of aspects L-100 to L-105, which neutralizes RSV via the same mechanism as VN04-2.

Aspect L-107. Compound or construct according to any of aspects L-91 to L-93 wherein said compound or construct competes with MAb C179 for binding to the hemagglutinin H5 envelope protein of influenza virus.

Aspect L-108. Compound or construct according to aspects L-107, wherein said compound or construct inhibits and/or blocks binding of MAb C179 to the hemagglutinin H5 envelope protein of influenza virus.

Aspect L-109. Compound or construct according to any of aspects L-107 to L-108, wherein said compound or construct is directed against the MAb C179 binding site on the hemagglutinin H5 envelope protein of influenza virus.

Aspect L-110. Compound or construct according to any of aspects L-107 to L-109, which comprises at least one amino acid sequence that is directed against and/or capable of binding to the MAb C179 binding site on the hemagglutinin H5 envelope protein of influenza virus and at least one further amino acid sequence that is capable of binding to at least one other antigenic determinant, epitope, part or domain of the hemagglutinin H5 envelope protein of influenza virus.

Aspect L-111. Compound or construct according to any of aspects L-107 to L-110, which comprises at least one amino acid sequence that is capable of competing with MAb C179 for binding to the hemagglutinin H5 envelope protein of influenza virus and at least one further amino acid sequence that is capable of binding to at least one other antigenic determinant, epitope, part or domain of the hemagglutinin H5 envelope protein of influenza virus.

Aspect L-112. Compound or construct according to any of aspects L-107 to L-111, which can simultaneously bind both binding sites on the hemagglutinin H5 envelope protein of influenza virus.

Aspect L-113. Compound or construct according to any of aspects L-107 to L-112, which neutralizes RSV via the same mechanism as MAb C179.

Aspect L-114. Compound or construct according to any of aspects L-38 to L-41, which comprises at least one amino acid sequence directed against a first antigenic determinant, epitope, part or domain of the G protein of rabies virus and at least one amino acid sequence directed against a second antigenic determinant, epitope, part or domain of the G protein of rabies virus different from the first antigenic determinant, epitope, part or domain.

Aspect L-115. Biparatopic compound or construct according to aspect L-114, which is capable of simultaneously binding to said first antigenic determinant, epitope, part or domain of the G protein of rabies virus and to said second antigenic determinant, epitope, part or domain of the G protein of rabies virus.

Aspect L-116. Compound or construct according to any of aspects L-114 to L-115, which combines two or more different modes of action each mediated by one of its binding units, wherein each binding unit binds at a different binding site of the G protein of rabies virus.

Aspect L-117. Compound or construct according to any of aspects L-114 to L-116 wherein said compound or construct competes with MAb 8-2 for binding to the G protein of rabies virus.

Aspect L-118. Compound or construct according to aspects L-117, wherein said compound or construct inhibits and/or blocks binding of MAb 8-2 to the G protein of rabies virus.

Aspect L-119. Compound or construct according to any of aspects L-117 to L-118, wherein said compound or construct is directed against the MAb 8-2 binding site on the G protein of rabies virus.

Aspect L-120. Compound or construct according to any of aspects L-117 to L-119, which comprises at least one amino acid sequence that is directed against and/or capable of binding to the MAb 8-2 binding site on the G protein of rabies virus and at least one further amino acid sequence that is capable of binding to at least one other antigenic determinant, epitope, part or domain of the G protein of rabies virus.

Aspect L-121. Compound or construct according to any of aspects L-117 to L-120, which comprises at least one amino acid sequence that is capable of competing with MAb 8-2 for binding to the G protein of rabies virus and at least one further amino acid sequence that is capable of binding to at least one other antigenic determinant, epitope, part or domain of the G protein of rabies virus.

Aspect L-122. Compound or construct according to any of aspects L-117 to L-121, which can simultaneously bind both binding sites on the G protein of rabies virus.

Aspect L-123. Compound or construct according to any of aspects L-117 to L-122, which neutralizes RSV via the same mechanism as MAb 8-2.

Aspect L-124. Compound or construct according to aspect L-9, which is a trivalent construct.

Aspect L-125. Compound or construct according to aspect L-124 that comprises three amino acid sequences that are directed against the same antigenic determinant, epitope, part or domain of the viral envelope protein.

Aspect L-126. Compound or construct according to aspect L-125, which can simultaneously bind the three antigenic determinants, epitopes, parts or domains of the viral envelope protein.

Aspect L-127. Compound or construct according to any of aspects L-125 to L-126, that comprises three amino acid sequences that are directed against and/or specifically bind the F protein of RSV virus.

Aspect L-128. Compound or construct according to aspect L-127, that comprises three amino acid sequences that are directed against and/or specifically bind the Synagis® binding site on the F protein of RSV virus.

Aspect L-129. Compound or construct according to any of aspects L-127 to L-128, that comprises three amino acid sequences that compete with Synagis® for binding the F protein of RSV virus.

Aspect L-130. Compound or construct according to any of aspects L-127 to L-129, that comprises three amino acid sequences that are directed against and/or specifically bind antigenic site II on the F protein of RSV virus.

Aspect L-131. Compound or construct according to any of aspects L-127 to L-130, that comprises three amino acid sequences that are directed against and/or specifically bind amino acid residues 250-275 of the F protein of RSV virus.

Aspect L-132. Compound or construct according to any of aspects L-125 to L-131, which can simultaneously bind all three binding sites on the F protein of RSV.

Aspect L-133. Compound or construct according to any of aspects L-127 to L-132, which neutralizes RSV via the same mechanism as Synagis®.

Aspect L-134. Compound or construct according to aspect L-127, that comprises three amino acid sequences that are directed against and/or specifically bind the 101F binding site on the F protein of RSV virus.

Aspect L-135. Compound or construct according to any of aspects L-127 and/or L-134, that comprises three amino acid sequences that compete with 101F for binding the F protein of RSV virus.

Aspect L-136. Compound or construct according to any of aspects L-127 and/or L-134 to L-135, that comprises three amino acid sequences that are directed against and/or specifically bind antigenic site IV-VI on the F protein of RSV virus.

Aspect L-137. Compound or construct according to any of aspects L-127 and/or L-134 to L-136, that comprises three amino acid sequences that are directed against and/or specifically bind amino acid residues 423-436 of the F protein of RSV virus.

Aspect L-138. Compound or construct according to any of aspects L-127 and/or L-134 to L-137, which can simultaneously bind all three binding sites on the F protein of RSV.

Aspect L-139. Compound or construct according to any of aspects L-127 and/or L-134 to L-138, which neutralizes RSV via the same mechanism as 101F.

Aspect L-140. Compound or construct according to any of aspects L-125 to L-126, that comprises three amino acid sequences that are directed against and/or specifically bind the hemagglutinin H5 envelope protein of influenza virus.

Aspect L-141. Compound or construct according to aspect L-140, that comprises three amino acid sequences that are directed against and/or specifically bind the sialic acid binding site on the hemagglutinin H5 envelope protein of influenza virus.

Aspect L-142. Compound or construct according to any of aspects L-140 to L-141, that comprises three amino acid sequences that compete with sialic acid for binding the hemagglutinin H5 envelope protein of influenza virus.

Aspect L-143. Compound or construct according to any of aspects L-140 to L-142, which can simultaneously bind all three binding sites on the hemagglutinin H5 envelope protein of influenza virus.

Aspect L-144. Compound or construct according to aspect L-140, that comprises three amino acid sequences that are directed against and/or specifically bind the VN04-2 binding site on the hemagglutinin H5 envelope protein of influenza virus.

Aspect L-145. Compound or construct according to any of aspects L-140 and/or L-144, that comprises three amino acid sequences that compete with VN04-2 for binding the hemagglutinin H5 envelope protein of influenza virus.

Aspect L-146. Compound or construct according to any of aspects L-140 and/or L-144 to L-145, which can simultaneously bind all three binding sites on the hemagglutinin H5 envelope protein of influenza virus.

Aspect L-147. Compound or construct according to any of aspects L-140 and/or L-144 to L-146, which neutralizes influenza virus via the same mechanism as VN04-2.

Aspect L-148. Compound or construct according to aspect L-140, that comprises three amino acid sequences that are directed against and/or specifically bind the MAb C179 binding site on the hemagglutinin H5 envelope protein of influenza virus.

Aspect L-149. Compound or construct according to any of aspects L-140 and/or L-148, that comprises three amino acid sequences that compete with MAb C179 for binding the hemagglutinin H5 envelope protein of influenza virus.

Aspect L-150. Compound or construct according to any of aspects L-140 and/or L-148 to L-149, which can simultaneously bind all three binding sites on the hemagglutinin H5 envelope protein of influenza virus.

Aspect L-151. Compound or construct according to any of aspects L-140 and/or L-148 to L-150, which neutralizes influenza virus via the same mechanism as MAb C179.

Aspect L-152. Compound or construct according to any of aspects L-125 to L-126, that comprises three amino acid sequences that are directed against and/or specifically bind the G envelope protein of rabies virus.

Aspect L-153. Compound or construct according to aspect L-152, that comprises three amino acid sequences that are directed against and/or specifically bind the MAb 8-2 binding site on the G envelope protein of rabies virus.

Aspect L-154. Compound or construct according to any of aspects L-152 to L-153, that comprises three amino acid sequences that compete with MAb 8-2 for binding the G envelope protein of rabies virus.

Aspect L-155. Compound or construct according to any of aspects L-152 to L-154, which can simultaneously bind all three binding sites on the G envelope protein of rabies virus.

Aspect L-156. Compound or construct according to any of aspects L-152 to L-155, which neutralizes influenza virus via the same mechanism as MAb 8-2.

Aspect L-157. Compound or construct according to aspect L-124 that comprises two amino acid sequences that are directed against a first antigenic determinant, epitope, part or domain of the viral envelope protein and one amino acid sequence that is directed against a second antigenic determinant, epitope, part or domain of the viral envelope protein.

Aspect L-158. Compound or construct according to aspect L-157, which can simultaneously bind the three antigenic determinants, epitopes, parts or domains of the viral envelope protein.

Aspect L-159. Compound or construct according to any of aspects L-157 to L-158, that comprises two amino acid sequences directed against and or capable of binding a first antigenic determinant, epitope, part or domain on the F protein of RSV virus, and one amino acid sequence directed against another antigenic determinant, epitope, part or domain on the F protein of RSV virus.

Aspect L-160. Compound or construct according to aspect L-159, that comprises two amino acid sequences directed against and or capable of binding the Synagis® binding site on the F protein of RSV virus, and one amino acid sequence directed against another determinant, epitope, part or domain on the F protein of RSV virus.

Aspect L-161. Compound or construct according to any of aspects L-159 to L-160, that comprises two amino acid sequences that compete with Synagis® for binding the F protein of RSV virus, and one amino acid sequence directed against another determinant, epitope, part or domain on the F protein of RSV virus.

Aspect L-162. Compound or construct according to any of aspects L-159 to L-161, that comprises two amino acid sequences that are directed against and/or specifically bind antigenic site II on the F protein of RSV virus, and one amino acid sequence directed against another determinant, epitope, part or domain on the F protein of RSV virus.

Aspect L-163. Compound or construct according to any of aspects L-159 to L-162, that comprises two amino acid sequences that are directed against and/or specifically bind amino acid residues 250-275 of the F protein of RSV virus, and one amino acid sequence directed against another determinant, epitope, part or domain on the F protein of RSV virus.

Aspect L-164. Compound or construct according to any of aspects L-159 to L-163, which can simultaneously bind all three binding sites on the F protein of RSV.

Aspect L-165. Compound or construct according to any of aspects L-159 to L-164, which neutralizes RSV via the same mechanism as Synagis®.

Aspect L-166. Compound or construct according to aspect L-159, that comprises two amino acid sequences directed against and or capable of binding the 101F binding site on the F protein of RSV virus, and one amino acid sequence directed against another determinant, epitope, part or domain on the F protein of RSV virus.

Aspect L-167. Compound or construct according to any of aspects L-159 and/or L-166, that comprises two amino acid sequences that compete with 101F for binding the F protein of RSV virus, and one amino acid sequence directed against another determinant, epitope, part or domain on the F protein of RSV virus.

Aspect L-168. Compound or construct according to any of aspects L-159 and/or L-166 to L-167, that comprises two amino acid sequences that are directed against and/or specifically bind antigenic site IV-VI on the F protein of RSV virus, and one amino acid sequence directed against another determinant, epitope, part or domain on the F protein of RSV virus.

Aspect L-169. Compound or construct according to any of aspects L-159 and/or L-166 to L-168, that comprises two amino acid sequences that are directed against and/or specifically bind amino acid residues 423-436 of the F protein of RSV virus, and one amino acid sequence directed against another determinant, epitope, part or domain on the F protein of RSV virus.

Aspect L-170. Compound or construct according to any of aspects any of aspects L-159 and/or L-166 to L-169, which can simultaneously bind all three binding sites on the F protein of RSV.

Aspect L-171. Compound or construct according to any of aspects L-159 and/or L-166 to L-170, which neutralizes RSV via the same mechanism as 101F.

Aspect L-172. Compound or construct according to aspect L-159, that comprises two amino acid sequences directed against and or capable of binding the Synagis® binding site on the F protein of RSV virus, and one amino acid sequence directed against and/or capable of binding the 101F binding site on the F protein of RSV virus.

Aspect L-173. Compound or construct according to any of aspects L-159 and/or L-172, that comprises two amino acid sequences that compete with Synagis® for binding the F protein of RSV virus, and one amino acid sequence that competes with 101F for binding the F protein of RSV virus.

Aspect L-174. Compound or construct according to any of aspects L-159 and/or L-172 to L-173, that comprises two amino acid sequences that are directed against and/or specifically bind antigenic site II on the F protein of RSV virus, and one amino acid sequence directed against and/or that can specifically bind antigenic site IV-VI of the F protein of RSV virus.

Aspect L-175. Compound or construct according to any of aspects L-159 and/or L-172 to L-174, that comprises two amino acid sequences that are directed against and/or specifically bind amino acid residues 250-275 of the F protein of RSV virus, and one amino acid sequence directed against and/or that can specifically bind amino acid residues 423-436 of the F protein of RSV virus.

Aspect L-176. Compound or construct according to any of aspects L-159, that comprises one amino acid sequence directed against and or capable of binding the Synagis® binding site on the F protein of RSV virus, and two amino acid sequences directed against and/or capable of binding the 101F binding site on the F protein of RSV virus.

Aspect L-177. Compound or construct according to any of aspects L-159 and/or L-176, that comprises one amino acid sequence that competes with Synagis® for binding the F protein of RSV virus, and two amino acid sequences that compete with 101F for binding the F protein of RSV virus.

Aspect L-178. Compound or construct according to any of aspects L-159 and/or L-176 to L-177, that comprises one amino acid sequence that is directed against and/or specifically binds antigenic site II on the F protein of RSV virus, and two amino acid sequences directed against and/or that can specifically bind antigenic site IV-VI of the F protein of RSV virus.

Aspect L-179. Compound or construct according to any of aspects L-159 and/or L-176 to L-178, that comprises one amino acid sequence that is directed against and/or specifically binds amino acid residues 250-275 of the F protein of RSV virus, and two amino acid sequences directed against and/or that can specifically bind amino acid residues 423-436 of the F protein of RSV virus.

Aspect L-180. Compound or construct according to any of aspects L-159 and/or L-172 to L-179, which can simultaneously bind all three binding sites on the F protein of RSV.

Aspect L-181. Compound or construct according to any of aspects L-159 and/or L-172 to L-180, which neutralizes RSV via the same mechanism as Synagis® and 101F.

Aspect L-182. Compound or construct according to any of aspects L-157 to L-158, that comprises two amino acid sequences directed against and and/or capable of binding a first antigenic determinant, epitope, part or domain on the hemagglutinin H5 envelope protein of influenza virus, and one amino acid sequence directed against another determinant, epitope, part or domain on the hemagglutinin H5 envelope protein of influenza virus.

Aspect L-183. Compound or construct according to aspect L-182, that comprises two amino acid sequences directed against and and/or capable of binding the sialic acid binding site on the hemagglutinin H5 envelope protein of influenza virus, and one amino acid sequence directed against another determinant, epitope, part or domain on the hemagglutinin H5 envelope protein of influenza virus.

Aspect L-184. Compound or construct according to any of aspects L-182 to L-183, that comprises two amino acid sequences that compete with sialic acid for binding the hemagglutinin H5 envelope protein of influenza virus, and one amino acid sequence directed against another determinant, epitope, part or domain on the hemagglutinin H5 envelope protein of influenza virus.

Aspect L-185. Compound or construct according to any of aspects any of aspects L-182 to L-184, which can simultaneously bind all three binding sites on the hemagglutinin H5 envelope protein of influenza virus.

Aspect L-186. Compound or construct according to aspects L-182, that comprises two amino acid sequences directed against and or capable of binding the VN04-2 binding site on the hemagglutinin H5 envelope protein of influenza virus, and one amino acid sequence directed against another determinant, epitope, part or domain on the hemagglutinin H5 envelope protein of influenza virus.

Aspect L-187. Compound or construct according to any of aspects L-182 and/or L-186, that comprises two amino acid sequences that compete with VN04-2 for binding the hemagglutinin H5 envelope protein of influenza virus, and one amino acid sequence directed against another determinant, epitope, part or domain on the hemagglutinin H5 envelope protein of influenza virus.

Aspect L-188. Compound or construct according to any of aspects any of aspects L-182 and/or L-186 to L-187, which can simultaneously bind all three binding sites on the hemagglutinin H5 envelope protein of influenza virus.

Aspect L-189. Compound or construct according to any of aspects L-182 and/or L-186 to L-188, which neutralizes influenza via the same mechanism as VN04-2.

Aspect L-190. Compound or construct according to aspect L-182 that comprises two amino acid sequences directed against and or capable of binding the MAb C179 binding site on the hemagglutinin H5 envelope protein of influenza virus, and one amino acid sequence directed against another determinant, epitope, part or domain on the hemagglutinin H5 envelope protein of influenza virus.

Aspect L-191. Compound or construct according to any of aspects L-182 and/or L-190, that comprises two amino acid sequences that compete with MAb C179 for binding the hemagglutinin H5 envelope protein of influenza virus, and one amino acid sequence directed against another determinant, epitope, part or domain on the hemagglutinin H5 envelope protein of influenza virus.

Aspect L-192. Compound or construct according to any of aspects any of aspects L-182 and/or L-190 to L-191, which can simultaneously bind all three binding sites on the hemagglutinin H5 envelope protein of influenza virus.

Aspect L-193. Compound or construct according to any of aspects L-182 and/or L-190 to L-192, which neutralizes influenza via the same mechanism as MAb C179.

Aspect L-194. Compound or construct according to any of aspects L-157 to L-158, that comprises two amino acid sequences directed against and or capable of binding a first antigenic determinant, epitope, part or domain on the G envelope protein of rabies virus, and one amino acid sequence directed against another antigenic determinant, epitope, part or domain on the G envelope protein of rabies virus.

Aspect L-195. Compound or construct according to aspects L-194, that comprises two amino acid sequences directed against and or capable of binding the MAb 8-2 binding site on the G envelope protein of rabies virus, and one amino acid sequence directed against another determinant, epitope, part or domain on the G envelope protein of rabies virus.

Aspect L-196. Compound or construct according to any of aspects L-194 to L-195, that comprises two amino acid sequences that compete with MAb 8-2 for binding the G envelope protein of rabies virus, and one amino acid sequence directed against another determinant, epitope, part or domain on the G envelope protein of rabies virus.

Aspect L-197. Compound or construct according to any of aspects any of aspects L-194 to L-196, which can simultaneously bind all three binding sites on the G envelope protein of rabies virus.

Aspect L-198. Compound or construct according to any of aspects L-194 to L-197, which neutralizes rabies via the same mechanism as MAb 8-2.

Aspect L-199. Compound or construct according to aspect L-124, that comprises one amino acid sequence that is directed against a first antigenic determinant, epitope, part or domain of the viral envelope protein, one amino acid sequence that is directed against a second antigenic determinant, epitope, part or domain of the viral envelope protein and one amino acid sequence that is directed against a third antigenic determinant, epitope, part or domain of the viral envelope protein.

Aspect L-200. Compound or construct according to aspect L-199, which can simultaneously bind the three antigenic determinants, epitopes, parts or domains of the viral envelope protein.

Aspect L-201. Compound or construct according to any of aspects L-199 or L-200, that comprises one amino acid sequence directed against and or capable of binding one antigenic determinant, epitope, part or domain on the F protein of RSV virus, and two amino acid sequence directed against another antigenic determinant, epitope, part or domain on the F protein of RSV virus.

Aspect L-202. Compound or construct according to aspect L-201, that comprises one amino acid sequence directed against and or capable of binding the Synagis® binding site on the F protein of RSV virus, and two amino acid sequence directed against another determinant, epitope, part or domain on the F protein of RSV virus.

Aspect L-203. Compound or construct according to any of aspects L-201 to L-202, that comprises one amino acid sequence that competes with Synagis® for binding the F protein of RSV virus, and two amino acid sequence directed against another determinant, epitope, part or domain on the F protein of RSV virus.

Aspect L-204. Compound or construct according to any of aspects L-201 to L-203, that comprises one amino acid sequence that is directed against and/or specifically binds antigenic site II on the F protein of RSV virus, and two amino acid sequences directed against another determinant, epitope, part or domain on the F protein of RSV virus.

Aspect L-205. Compound or construct according to any of aspects L-201 to L-204, that comprises one amino acid sequence that is directed against and/or specifically binds amino acid residues 250-275 of the F protein of RSV virus, and two amino acid sequences directed against another determinant, epitope, part or domain on the F protein of RSV virus.

Aspect L-206. Compound or construct according to any of aspects L-201 to L-205, which can simultaneously bind all three binding sites on the F protein of RSV.

Aspect L-207. Compound or construct according to any of aspects L-201 to L-206, which neutralizes RSV via the same mechanism as Synagis®.

Aspect L-208. Compound or construct according to aspect L-201, that comprises one amino acid sequence directed against and or capable of binding the 101F binding site on the F protein of RSV virus, and two amino acid sequences directed against another determinant, epitope, part or domain on the F protein of RSV virus.

Aspect L-209. Compound or construct according to any of aspects L-201 and/or L-208, that comprises one amino acid sequence that competes with 101F for binding the F protein of RSV virus, and two amino acid sequence directed against another determinant, epitope, part or domain on the F protein of RSV virus.

Aspect L-210. Compound or construct according to any of aspects L-201 and/or L-208 to L-209, that comprises one amino acid sequence that is directed against and/or specifically bind antigenic site IV-VI on the F protein of RSV virus, and two amino acid sequence directed against another determinant, epitope, part or domain on the F protein of RSV virus.

Aspect L-211. Compound or construct according to any of aspects L-201 and/or L-208 to L-210, that comprises one amino acid sequence that is directed against and/or specifically binds amino acid residues 423-436 of the F protein of RSV virus, and two amino acid sequences directed against another determinant, epitope, part or domain on the F protein of RSV virus.

Aspect L-212. Compound or construct according to any of aspects L-201 and/or L-208 to L-211, which can simultaneously bind all three binding sites on the F protein of RSV.

Aspect L-213. Compound or construct according to any of aspects L-201 and/or L-208 to L-212, which neutralizes RSV via the same mechanism as 101F.

Aspect L-214. Compound or construct according to aspect L-201, that comprises one amino acid sequence directed against and and/or capable of binding the Synagis® binding site on the F protein of RSV virus, one amino acid sequence directed against and/or capable of binding the 101F binding site on the F protein of RSV virus, and one amino acid sequence directed against another determinant, epitope, part or domain on the F protein of RSV virus.

Aspect L-215. Compound or construct according to any of aspects L-201 and/or L-214, that comprises one amino acid sequence that competes with Synagis® for binding the F protein of RSV virus, one amino acid sequence that competes with 101F for binding the F protein of RSV virus, and one amino acid sequence directed against another determinant, epitope, part or domain on the F protein of RSV virus.

Aspect L-216. Compound or construct according to any of aspects L-201 and/or L-214 to L-215, that comprises one amino acid sequence that is directed against and/or specifically binds antigenic site II on the F protein of RSV virus, one amino acid sequence directed against and/or that can specifically bind antigenic site IV-VI of the F protein of RSV virus, and one amino acid sequence directed against another determinant, epitope, part or domain on the F protein of RSV virus.

Aspect L-217. Compound or construct according to any of aspects L-201 and/or L-214 to L-216, that comprises one amino acid sequence that is directed against and/or specifically binds amino acid residues 250-275 of the F protein of RSV virus, one amino acid sequence directed against and/or that can specifically bind amino acid residues 423-436 of the F protein of RSV virus, and one amino acid sequence directed against another determinant, epitope, part or domain on the F protein of RSV virus.

Aspect L-218. Compound or construct according to any of aspects L-201 and/or L-214 to L-217, which can simultaneously bind all three binding sites on the F protein of RSV.

Aspect L-219. Compound or construct according to any of aspects L-201 and/or L-214 to L-218, which neutralizes RSV via the same mechanism as Synagis® and 101F.

Aspect L-220. Compound or construct according any of aspects L-199 or L-200, that comprises one amino acid sequence directed against and or capable of binding one antigenic determinant, epitope, part or domain on the hemagglutinin H5 envelope protein of influenza virus, and two amino acid sequences directed against another antigenic determinant, epitope, part or domain on the hemagglutinin H5 envelope protein of influenza virus.

Aspect L-221. Compound or construct according aspect L-220, that comprises one amino acid sequence directed against and or capable of binding the sialic acid binding site on the hemagglutinin H5 envelope protein of influenza virus, and two amino acid sequences directed against another determinant, epitope, part or domain on the hemagglutinin H5 envelope protein of influenza virus.

Aspect L-222. Compound or construct according to any of aspects L-220 to L-221, that comprises one amino acid sequence that competes with sialic acid for binding the hemagglutinin H5 envelope protein of influenza virus, and two amino acid sequences directed against another determinant, epitope, part or domain on the hemagglutinin H5 envelope protein of influenza virus.

Aspect L-223. Compound or construct according to any of aspects any of aspects L-220 to L-222, which can simultaneously bind all three binding sites on the hemagglutinin H5 envelope protein of influenza virus.

Aspect L-224. Compound or construct according to aspects L-220, that comprises one amino acid sequence directed against and or capable of binding the VN04-2 binding site on the hemagglutinin H5 envelope protein of influenza virus, and two amino acid sequences directed against another determinant, epitope, part or domain on the hemagglutinin H5 envelope protein of influenza virus.

Aspect L-225. Compound or construct according to any of aspects L-220 and/or L-224, that comprises one amino acid sequence that competes with VN04-2 for binding the hemagglutinin H5 envelope protein of influenza virus, and two amino acid sequences directed against another determinant, epitope, part or domain on the hemagglutinin H5 envelope protein of influenza virus.

Aspect L-226. Compound or construct according to any of aspects L-220 and/or L-224 to L-225, which can simultaneously bind all three binding sites on the hemagglutinin H5 envelope protein of influenza virus.

Aspect L-227. Compound or construct according to any of aspects L-220 and/or L-224 to L-226, which neutralizes influenza via the same mechanism as VN04-2.

Aspect L-228. Compound or construct according to aspect L-220, that comprises one amino acid sequence directed against and or capable of binding the MAb C179 binding site on the hemagglutinin H5 envelope protein of influenza virus, and two amino acid sequences directed against another determinant, epitope, part or domain on the hemagglutinin H5 envelope protein of influenza virus.

Aspect L-229. Compound or construct according to any of aspects L-220 and/or L-228, that comprises one amino acid sequence that competes with MAb C179 for binding the hemagglutinin H5 envelope protein of influenza virus, and two amino acid sequences directed against another determinant, epitope, part or domain on the hemagglutinin H5 envelope protein of influenza virus.

Aspect L-230. Compound or construct according to any of aspects L-220 and/or L-228 to L-229, which can simultaneously bind all three binding sites on the hemagglutinin H5 envelope protein of influenza virus.

Aspect L-231. Compound or construct according to any of aspects L-220 and/or L-228 to L-230, which neutralizes influenza via the same mechanism as MAb C179.

Aspect L-232. Compound or construct according to any of aspects L-199 or L-200, that comprises one amino acid sequence directed against and or capable of binding one antigenic determinant, epitope, part or domain on the G envelope protein of rabies virus, and two amino acid sequences directed against another antigenic determinant, epitope, part or domain on the G envelope protein of rabies virus.

Aspect L-233. Compound or construct according to aspect L-232, that comprises one amino acid sequence directed against and or capable of binding the MAb 8-2 binding site on the G envelope protein of rabies virus, and two amino acid sequences directed against another determinant, epitope, part or domain on the G envelope protein of rabies virus.

Aspect L-234. Compound or construct according to any of aspects L-232 or L-233, that comprises one amino acid sequence that competes with MAb 8-2 for binding the G envelope protein of rabies virus, and two amino acid sequences directed against another determinant, epitope, part or domain on the G envelope protein of rabies virus.

Aspect L-235. Compound or construct according to any of aspects any of aspects L-232 to L-234, which can simultaneously bind all three binding sites on the G envelope protein of rabies virus.

Aspect L-236. Compound or construct according to any of aspects L-232 to L-236, which neutralizes rabies via the same mechanism as MAb 8-2.

Aspect L-237. Compound or construct that comprises or that is chosen from the group consisting of SEQ ID NO's: 2382 to 2415, 2423 to 2430, 2641 to 2659, 2663 to 2681, 2978 to 2998, 3016 to 3056 and 3584 to 3591 or from the group consisting of from amino acid sequences that have more than 80%, preferably more than 90%, more preferably more than 95%, such as 99% or more sequence identity (as defined herein) with at least one of the amino acid sequences of SEQ ID NO's: 2382 to 2415, 2423 to 2430, 2641 to 2659, 2663 to 2681, 2978 to 2998, 3016 to 3056 and 3584 to 3591.

Aspect L-238. Compound or construct according to any of aspects L-1 to L-9, which is a multispecific construct.

Aspect L-239. Compound or construct according to any of aspects L-1 to L-238, which has an increased half-life, compared to the corresponding amino acid sequence according to any of aspects A-1 to A-109, B-1 to B-28, C-1 to C-16, D-1 to D-6, E-1 to E-14 and/or F-1 to F-47 per se or NANOBODY® ($V_{HH}$ sequence) according to any of aspects H-1 to H-137 per se, or polypeptide according to any of aspects K-1 to K-19 per se, respectively.

Aspect L-240. Compound or construct according to any of aspects L-1 to L-239, in which said one or more other groups, residues, moieties or binding units provide the compound or construct with increased half-life, compared to the corresponding amino acid sequence according to any of aspects A-1 to A-109, B-1 to B-28, C-1 to C-16, D-1 to D-6, E-1 to E-14 and/or F-1 to F-47 per se or NANOBODY® ($V_{HH}$ sequence) according to any of aspects H-1 to H-137 per se, or polypeptide according to any of aspects K-1 to K-19 per se, respectively.

Aspect L-241. Compound or construct according to aspect L-240, in which said one or more other groups, residues, moieties or binding units that provide the compound or construct with increased half-life is chosen from the group consisting of serum proteins or fragments thereof, binding units that can bind to serum proteins, an Fc portion, and small proteins or peptides that can bind to serum proteins.

Aspect L-242. Compound or construct according to any of aspects L-240 or L-241, in which said one or more other groups, residues, moieties or binding units that provide the compound or construct with increased half-life is chosen from the group consisting of human serum albumin or fragments thereof.

Aspect L-243. Compound or construct according to any of aspects L-240 to L-242, in which said one or more other groups, residues, moieties or binding units that provide the compound or construct with increased half-life are chosen from the group consisting of binding units that can bind to serum albumin (such as human serum albumin) or a serum immunoglobulin (such as IgG).

Aspect L-244. Compound or construct according to any of aspects L-240 to L-243, in which said one or more other groups, residues, moieties or binding units that provides the compound or construct with increased half-life are chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or NANOBODIES® ($V_{HH}$ sequences) that can bind to serum albumin (such as human serum albumin) or a serum immunoglobulin (such as IgG).

Aspect L-245. Compound or construct according to any of aspects L-240 to L-244, in which said one or more other groups, residues, moieties or binding units that provides the compound or construct with increased half-life is a NANOBODY® ($V_{HH}$ sequence) that can bind to serum albumin (such as human serum albumin) or a serum immunoglobulin (such as IgG).

Aspect L-246. Compound or construct that comprises an Fc portion of an immunoglobulin and two or more NANOBODIES® ($V_{HH}$ sequences) according to any of aspects H-1 to H-137.

Aspect L-247. Compound or construct that comprises an Fc portion of an immunoglobulin and one or more compounds or constructs according to any of aspects L-10 to L-246.

Aspect L-248. Compound or construct according to aspects L-246 and L-247, that comprises an Fc portion of an immunoglobulin, one or more NANOBODIES® ($V_{HH}$ sequences) according to any of aspects H-1 to H-137 and one or more compounds or constructs according to any of aspects L-10 to L-245.

Aspect L-249. Compound or construct according to any of aspects L-246 or L-248, wherein the Fc portion is derived from an immunoglobulin selected from IgG1, IgG2, IgGA, IgM and IgE.

Aspect L-250. Compound or construct according to any of aspects L-246 to L-249, wherein the NANOBODIES® ($V_{HH}$ sequences) according to any of aspects H-1 to H-137 or compounds or constructs according to any of aspects L-10 to L-245 are coupled to the Fc portion via a suitable linker.

Aspect L-251. Compound or construct according to aspect L-250, wherein the linker is a hinge linker.

Aspect L-252. Compound or construct according to any of aspects L-246 to L-251, wherein the NANOBODIES® ($V_{HH}$ sequences) according to any of aspects H-1 to H-137 or compounds or constructs according to any of aspects L-10 to L-245 are coupled at one side of the Fc portion.

Aspect L-253. Compound or construct according to any of aspects L-246 to L-252, wherein the NANOBODIES® ($V_{HH}$ sequences) according to any of aspects H-1 to H-137 or compounds or constructs according to any of aspects L-10 to L-245 are coupled at both side of the Fc portion.

Aspect L-254. Compound or construct according to any of aspects L-246 to L-253, which has a structure as depicted in FIG. 59.

Aspect L-255. Compound or construct according to any of aspects L-246 to L-253, which has a structure as depicted in FIG. 60.

Aspect L-256. Compound or construct according to any of aspects L-246 to L-253, which has a structure as depicted in FIG. 61.

Aspect L-257. Compound or construct according to any of aspects L-246 to L-253, which has a structure as depicted in FIG. 62.

Aspect L-258. Compound or construct according to any of aspects L-246 to L-253, which has a structure as depicted in FIG. 63.

Aspect L-259. Compound or construct according to any of aspects L-246 to L-253, that is chosen from the group consisting of SEQ ID NO's: 2641 to 2659 and 2978 to 2988.

Aspect L-260. Compound or construct according to any of aspects L-239 to L-259, that has a serum half-life that is at least 1.5 times, preferably at least 2 times, such as at least 5 times, for example at least 10 times or more than 20 times, greater than the half-life of the corresponding amino acid sequence according to any of aspects A-1 to A-109, B-1 to B-28, C-1 to C-16, D-1 to D-6, E-1 to E-14 and/or F-1 to F-47 per se or NANOBODY® ($V_{HH}$ sequence) according to any of aspects H-1 to H-137 per se, or polypeptide according to any of aspects K-1 to K-19 per se, respectively.

Aspect L-261. Compound or construct according to any of aspects L-239 to L-260, that has a serum half-life that is increased with more than 1 hours, preferably more than 2 hours, more preferably more than 6 hours, such as more than 12 hours, or even more than 24, 48 or 72 hours, compared to the corresponding amino acid sequence according to any of aspects A-1 to A-109, B-1 to B-28, C-1 to C-16, D-1 to D-6, E-1 to E-14 and/or F-1 to F-47 per se or NANOBODY® ($V_{HH}$ sequence) according to any of aspects H-1 to H-137 per se, or polypeptide according to any of aspects K-1 to K-19 per se, respectively.

Aspect L-262. Compound or construct according to any of aspects L-239 to L-261, that has a serum half-life in human of at least about 12 hours, preferably at least 24 hours, more preferably at least 48 hours, even more preferably at least 72 hours or more; for example, of at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).

Aspect G-1: Monovalent construct, comprising or essentially consisting of one amino acid sequence according to any of aspects A-1 to A-109, B-1 to B-28, C-1 to C-16, D-1 to D-6, E-1 to E-14 and/or F-1 to F-47 and/or one NANOBODY® ($V_{HH}$ sequence) according to any of aspects H-1 to H-137.

Aspect G-2: Monovalent construct according to aspect G-1, in which said amino acid sequence of the invention is chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or NANOBODIES® ($V_{HH}$ sequences).

Aspect G-3: Monovalent construct, comprising or essentially consisting of one NANOBODY® ($V_{HH}$ sequence) according to any of aspects H-1 to H-137.

Aspect G-4: Monovalent construct, that is chosen from the group consisting of SEQ ID NO's: 126 to 407, 2431 to 2448, 2574 to 2581, 2682 to 2717 and 3064 to 3128 or from the group consisting of amino acid sequences that have more than 80%, preferably more than 90%, more preferably more than 95%, such as 99% or more sequence identity (as defined herein) with at least one of the amino acid sequences of SEQ ID NO's: 126 to 407, 2431 to 2448, 2574 to 2581, 2682 to 2717 and 3064 to 3128.

Aspect G-5: Use of a monovalent construct according to any of aspects G-1 to G-4, in preparing a multivalent compound or construct according to any of aspects L-1 to L-262.

Aspect G-6: Use of a monovalent construct according to aspect G-5, in preparing a multiparatopic construct such as a bivalent, biparatopic, trivalent, triparatopic construct.

Aspect G-7: Use of a monovalent construct according to any of aspects G-5 or G-6, wherein the monovalent construct is used as a binding domain or binding unit in preparing a multivalent construct comprising two or more binding units.

Aspect G-8: Use of a monovalent construct according to any of aspects G-5 to G-7, in preparing a multivalent construct that exhibits intramolecular binding compared to intermolecular binding.

Aspect G-9: Use of a monovalent construct according to any of aspects G-5 to G-8, as a binding domain or binding unit in preparing a multivalent construct, wherein the binding domains or binding units are linked via a linker such that the multivalent construct preferably exhibits intramolecular binding compared to intermolecular binding.

Aspect G-10: Use of a monovalent construct according to any of aspects G-5 to G-9, wherein the monovalent construct is directed against the Synagis® binding site on the F envelope protein of RSV virus and/or is capable of competing with Synagis® for binding to the F envelope protein of RSV virus.

Aspect G-11: Use of a monovalent construct according to any of aspects G-5 to G-10, wherein the monovalent construct is directed against antigenic site II of the F envelope protein of RSV virus.

Aspect G-12: Use of a monovalent construct according to any of aspects G-5 to G-11, wherein the monovalent construct is directed against amino acid residues 250-275 of the F envelope protein of RSV virus.

Aspect G-13: Use of a monovalent construct according to any of aspects G-5 to G-9, wherein the monovalent construct is directed against the 101F binding site on the F envelope protein of RSV virus and/or is capable of competing with 101F for binding to the F envelope protein of RSV virus.

Aspect G-14: Use of a monovalent construct according to any of aspects G-5 to G-9 and/or G-13, wherein the monovalent construct is directed against antigenic site IV-VI of the F envelope protein of RSV virus.

Aspect G-15: Use of a monovalent construct according to any of aspects G-5 to G-9 and/or G-13 to G-14, wherein the monovalent construct is directed against amino acid residues 423-436 of the F envelope protein of RSV virus.

Aspect G-16: Use of two monovalent constructs according to any of aspects G-5 to G-9, wherein a first monovalent construct is directed against the Synagis® binding site on the F envelope protein of RSV virus (and in particular against antigenic site II of the F envelope protein of RSV virus, and more in particular against amino acid residues 250-275 of the F envelope protein of RSV virus) and/or is capable of competing with Synagis® for binding to the F envelope protein of RSV virus and wherein the second monovalent construct is directed against the 101F binding site on the F envelope protein of RSV virus (and in particular against antigenic site IV-VI of the F envelope protein of RSV virus, and more in particular against amino acid residues 423-436 of the F envelope protein of RSV virus) and/or is capable of competing with 101F for binding to the F envelope protein of RSV virus.

Aspect G-17: Use of two monovalent constructs according to any of aspects G-5 to G-9 for the preparation of a bivalent compound or construct, wherein the monovalent constructs are directed against the Synagis® binding site on the F envelope protein of RSV virus (and in particular against antigenic site II of the F envelope protein of RSV virus, and more in particular against amino acid residues 250-275 of the F envelope protein of RSV virus) and/or capable of competing with Synagis® for binding to the F envelope protein of RSV virus.

Aspect G-18: Use of three monovalent constructs according to any of aspects G-5 to G-9 for the preparation of a trivalent compound or construct, wherein the monovalent constructs are directed against the Synagis® binding site on the F envelope protein of RSV virus (and in particular against antigenic site II of the F envelope protein of RSV virus, and more in particular against amino acid residues 250-275 of the F envelope protein of RSV virus) and/or capable of competing with Synagis® for binding to the F envelope protein of RSV virus.

Aspect G-19: Use of two monovalent constructs according to any of aspects G-5 to G-9 for the preparation of a bivalent compound or construct, wherein the monovalent constructs are directed against the 101F binding site on the F envelope protein of RSV virus (and in particular against antigenic site IV-VI of the F envelope protein of RSV virus, and more in particular against amino acid residues 423-436 of the F envelope protein of RSV virus) and/or capable of competing with 101F for binding to the F envelope protein of RSV virus.

Aspect G-20: Use of three monovalent constructs according to any of aspects G-5 to G-9 for the preparation of a trivalent compound or construct, wherein the monovalent constructs are directed against the 101F binding site on the F envelope protein of RSV virus (and in particular against antigenic site IV-VI of the F envelope protein of RSV virus, and more in particular against amino acid residues 423-436 of the F envelope protein of RSV virus) and/or capable of competing with 101F for binding to the F envelope protein of RSV virus.

Aspect G-21: Use of a monovalent construct according to any of aspects G-5 to G-9, wherein the monovalent construct is directed against the sialic acid binding site on the hemagglutinin H5 envelope protein of influenza virus and/or is capable of competing with sialic acid for binding to the hemagglutinin H5 envelope protein of influenza virus.

Aspect G-22: Use of two monovalent constructs according to any of aspects G-5 to G-9, for the preparation of a bivalent compound or construct, wherein the monovalent constructs are directed against the sialic acid binding site on the hemagglutinin H5 envelope protein of influenza virus and/or is capable of competing with sialic acid for binding to the hemagglutinin H5 envelope protein of influenza virus.

Aspect G-23: Use of three monovalent constructs according to any of aspects G-5 to G-9, for the preparation of a trivalent compound or construct, wherein the monovalent constructs are directed against the sialic acid binding site on the hemagglutinin H5 envelope protein of influenza virus and/or are capable of competing with sialic acid for binding to the hemagglutinin H5 envelope protein of influenza virus.

Aspect G-24: Use of a monovalent construct according to any of aspects G-5 to G-9, wherein the monovalent construct is directed against the VN04-2 binding site on the hemagglutinin H5 envelope protein of influenza virus and/or is capable of competing with VN04-2 for binding to the hemagglutinin H5 envelope protein of influenza virus.

Aspect G-25: Use of two monovalent constructs according to any of aspects G-5 to G-9, for the preparation of a bivalent compound or construct, wherein the monovalent constructs are directed against the VN04-2 binding site on the hemagglutinin H5 envelope protein of influenza virus and/or are capable of competing with VN04-2 for binding to the hemagglutinin H5 envelope protein of influenza virus.

Aspect G-26: Use of three monovalent constructs according to any of aspects G-5 to G-9, for the preparation of a trivalent compound or construct, wherein the monovalent constructs are directed against the VN04-2 binding site on the hemagglutinin H5 envelope protein of influenza virus and/or are capable of competing with VN04-2 for binding to the hemagglutinin H5 envelope protein of influenza virus.

Aspect G-27: Use of a monovalent construct according to any of aspects G-5 to G-9, wherein the monovalent construct is directed against the MAb C179 binding site on the hemagglutinin H5 envelope protein of influenza virus and/or is capable of competing with VN04-2 for binding to the hemagglutinin H5 envelope protein of influenza virus.

Aspect G-28: Use of two monovalent constructs according to any of aspects G-5 to G-9, for the preparation of a bivalent compound or construct, wherein the monovalent constructs are directed against the MAb C179 binding site on the hemagglutinin H5 envelope protein of influenza virus and/or are capable of competing with VN04-2 for binding to the hemagglutinin H5 envelope protein of influenza virus.

Aspect G-29: Use of three monovalent constructs according to any of aspects G-5 to G-9, for the preparation of a trivalent compound or construct, wherein the monovalent constructs are directed against the MAb C179 binding site on the hemagglutinin H5 envelope protein of influenza virus and/or are capable of competing with VN04-2 for binding to the hemagglutinin H5 envelope protein of influenza virus.

Aspect G-30: Use of a monovalent construct according to any of aspects G-5 to G-9, wherein the monovalent construct is directed against the MAb 8-2 binding site on the G envelope protein of rabies virus and/or is capable of competing with MAb 8-2 for binding to the G envelope protein of rabies virus.

Aspect G-31: Use of two monovalent constructs according to any of aspects G-5 to G-9, for the preparation of a bivalent construct, wherein the monovalent constructs are directed against the MAb 8-2 binding site on the G envelope protein of rabies virus and/or are capable of competing with MAb 8-2 for binding to the G envelope protein of rabies virus.

Aspect G-32: Use of three monovalent constructs according to any of aspects G-5 to G-9, for the preparation of a trivalent construct, wherein the monovalent constructs are directed against the MAb 8-2 binding site on the G envelope protein of rabies virus and/or are capable of competing with MAb 8-2 for binding to the G envelope protein of rabies virus.

Aspect M-1: Nucleic acid or nucleotide sequence, that encodes an amino acid sequence according to any of aspects A-1 to A-109, B-1 to B-28, C-1 to C-16, D-1 to D-6, E-1 to E-14 and/or F-1 to F-47, a NANOBODY® ($V_{HH}$ sequence) according to any of aspects H-1 to H-137, a polypeptide according to any of aspects K-1 to K-19, a compound or construct according to any of aspects L-1 to L-262, that is such that it can be obtained by expression of a nucleic acid or nucleotide sequence encoding the same, or a monovalent construct according to any of aspects G-1 to G-32.

Aspect M-2: Nucleic acid or nucleotide sequence according to aspect M-1, that is in the form of a genetic construct.

Aspect M-3: Use of a nucleic acid or nucleotide sequence according to aspect M-1, that encodes a monovalent construct according to any of aspects G-1 to G-32, for the preparation of a genetic construct that encodes a multivalent construct according to any of aspects L-1 to L-262.

Aspect M-4: Use of a nucleic acid or nucleotide sequence according to aspect M-2, wherein the genetic construct encodes a multiparatopic (such as a biparatopic) construct.

Aspect N-1: Host or host cell that expresses, or that under suitable circumstances is capable of expressing, an amino acid sequence according to any of aspects A-1 to A-109, B-1 to B-28, C-1 to C-16, D-1 to D-6, E-1 to E-14 and/or F-1 to F-47, a NANOBODY® ($V_{HH}$ sequence) according to any of aspects H-1 to H-137, a polypeptide according to any of aspects K-1 to K-19, a compound or construct according to any of aspects L-1 to L-262, that is such that it can be obtained by expression of a nucleic acid or nucleotide sequence encoding the same, or a monovalent construct according to any of aspects G-1 to G-32; and/or that comprises a nucleic acid or nucleotide sequence according to aspects M-1 or M-2.

Aspect O-1: Composition, comprising at least one amino acid sequence according to any of aspects A-1 to A-109, B-1 to B-28, C-1 to C-16, D-1 to D-6, E-1 to E-14 and/or F-1 to F-47, NANOBODY® ($V_{HH}$ sequence) according to any of aspects H-1 to H-137, polypeptide according to any of aspects K-1 to K-19, compound or construct according to any of aspects L-1 to L-262, monovalent construct according to any of aspects G-1 to G-32, or nucleic acid or nucleotide sequence according to aspects M-1 or M-2.

Aspect O-2: Composition according to aspect O-1, which is a pharmaceutical composition.

Aspect O-3: Composition according to aspects O-1 or O-2, which is a pharmaceutical composition, that further comprises at least one pharmaceutically acceptable carrier, diluent or excipient and/or adjuvant, and that optionally comprises one or more further pharmaceutically active polypeptides and/or compounds.

Aspect P-1: Method for producing an amino acid sequence according to any of aspects A-1 to A-109, B-1 to B-28, C-1 to C-16, D-1 to D-6, E-1 to E-14 and/or F-1 to F-47, a NANOBODY® ($V_{HH}$ sequence) according to any of aspects H-1 to H-137, a polypeptide according to any of aspects K-1 to K-19, a compound or construct according to any of aspects L-1 to L-262, that is such that it can be obtained by expression of a nucleic acid or nucleotide sequence encoding the same, a monovalent construct according to any of aspects G-1 to G-32, or a composition according to any of aspects O-1 to O-3, said method at least comprising the steps of:

a. expressing, in a suitable host cell or host organism or in another suitable expression system, a nucleic acid or nucleotide sequence according to aspects M-1 or M-2, optionally followed by:

b. isolating and/or purifying the amino acid sequence according to any of aspects A-1 to A-109, B-1 to B-28, C-1 to C-16, D-1 to D-6, E-1 to E-14 and/or F-1 to F-47, the NANOBODY® ($V_{HH}$ sequence) according to any of aspects H-1 to H-137, the polypeptide according to any of aspects K-1 to K-19, the compound or construct according to any of aspects L-1 to L-262, that is such that it can be obtained by expression of a nucleic acid or nucleotide sequence encoding the same, or the monovalent construct according to any of aspects G-1 to G-32 thus obtained.

Aspect P-2: Method for producing an amino acid sequence according to any of aspects A-1 to A-109, B-1 to B-28, C-1 to C-16, D-1 to D-6, E-1 to E-14 and/or F-1 to F-47, a NANOBODY® ($V_{HH}$ sequence) according to any of aspects H-1 to H-137, a polypeptide according to any of aspects K-1 to K-19, a compound or construct according to any of aspects L-1 to L-262, that is such that it can be obtained by expression of a nucleic acid or nucleotide sequence encoding the same, a monovalent construct according to any of aspects G-1 to G-32, or a composition according to any of aspects O-1 to O-3, said method at least comprising the steps of:

a. cultivating and/or maintaining a host or host cell according to aspect N-1 under conditions that are such that said host or host cell expresses and/or produces at least one amino acid sequence according to any of aspects A-1 to A-109, B-1 to B-28, C-1 to C-16, D-1 to D-6, E-1 to E-14 and/or F-1 to F-47, NANOBODY® ($V_{HH}$ sequence) according to any of aspects H-1 to H-137, polypeptide according to any of aspects K-1 to K-19, compound or construct according to any of aspects L-1 to L-262, that is such that it can be obtained by expression of a nucleic acid or nucleotide sequence encoding the same, a monovalent construct according to any of aspects G-1 to G-32, or composition according to any of aspects O-1 to O-3, optionally followed by:

b. isolating and/or purifying the amino acid sequence according to any of aspects A-1 to A-109, B-1 to B-28, C-1 to C-16, D-1 to D-6, E-1 to E-14 and/or F-1 to F-47, the NANOBODY® ($V_{HH}$ sequence) according to any of aspects H-1 to H-137, the polypeptide according to any of aspects K-1 to K-19, the compound or construct according to any of aspects L-1 to L-262, that is such that it can be obtained by expression of a nucleic acid or nucleotide sequence encoding the same, or a monovalent construct according to any of aspects G-1 to G-32, or the composition according to aspects O-1 to O-3, thus obtained.

Aspect P-3: Method for preparing and/or generating a multi-paratopic (such as e.g. biparatopic, triparatopic, etc.) construct according to any of aspects L-38 to L-123 and/or L-157 to L-236, said method comprising at least the steps of:

a. providing a nucleic acid sequence according to aspect M-1, encoding a first viral envelope protein binding amino acid sequence, fused to a set, collection or library of nucleic acid sequences encoding amino acid sequences;

b. screening said set, collection or library of nucleic acid sequences for nucleic acid sequences that encode a second amino acid sequence that can bind to and/or has affinity for an antigenic determinant on the viral envelope protein different from the antigenic determinant recognized by the first viral envelope protein binding amino acid sequence;

and c. isolating the nucleic acid sequence encoding a the viral envelope protein binding amino acid sequence fused to the nucleic acid sequence obtained in b), followed by expressing the encoded construct.

Aspect P-4: Method for preparing and/or generating a biparatopic or triparatopic construct according to any of aspects L-38 to L-123 or L-157 to L-236, said method comprising at least the steps of:

a. providing a set, collection or library of nucleic acid sequences, in which each nucleic acid sequence in said set, collection or library encodes a fusion protein that comprises a first amino acid sequence that can bind to and/or has affinity for a first antigenic determinant, part, domain or epitope on a viral envelope protein that is fused (optionally via a linker sequence) to a second amino acid sequence, in which essentially each second amino acid sequence (or most of these) is a different member of a set, collection or library of different amino acid sequences;

b. screening said set, collection or library of nucleic acid sequences for nucleic acid sequences that encode an amino acid sequence that can bind to and/or has affinity for a second antigenic determinant, part, domain or epitope on the viral envelope protein different from the first antigenic determinant, part, domain or epitope on the viral envelope protein;

and c. isolating the nucleic acid sequences that encode an amino acid sequence that can bind to and/or has affinity for a second antigenic determinant, part, domain or epitope on the viral envelope protein different from the first antigenic determinant, part, domain or epitope on the viral envelope protein, obtained in b), optionally followed by expressing the encoded amino acid sequence.

Aspect P-5: Method according to aspect P-4, wherein the first amino acid is also encoded by a set, collection or library of nucleic acid sequences and wherein, in step b), said set, collection or library of nucleic acid sequences is screened for nucleic acid sequences that encode an amino acid sequence that can bind to and/or has affinity for the first antigenic determinant, part, domain or epitope on the viral envelope protein.

Aspect P-6: Method according to aspect P-5, wherein the screening in step b) is performed in a single step.

Aspect P-7: Method according to aspect P-5, wherein the screening in step b) is performed in subsequent steps.

Aspect P-8: Method according to any of aspects P-4 to P-7, wherein the first amino acid sequence used in step a) is preferably such that (i) it can bind to and/or has affinity for the Synagis® binding site on the F envelope protein of RSV virus (and in particular antigenic site II of the F envelope protein of RSV virus, more in particular at least amino acid residues 250-275 of the F envelope protein of RSV virus) and/or (ii) it competes with Synagis® for binding to the F envelope protein of RSV virus.

Aspect P-9: Method according to any of aspects P-4 to P-8, wherein in step b), the set, collection or library of nucleic acid sequences is screened for nucleic acid sequences that encode (i) an amino acid sequence that can bind to and/or has affinity for the 101F binding site on the F envelope protein of RSV virus (and in particular antigenic site IV-VI of the F envelope protein of RSV virus, more in particular at least amino acid residues 423-436 of the F envelope protein of RSV virus) and/or (ii) an amino acid sequence that can compete with 101F for binding to the F envelope protein of RSV virus.

Aspect P-10: Method according to any of aspects P-4 to P-7, wherein the first amino acid sequence used in step a) is preferably such that (i) it can bind to and/or has affinity for the 101F binding site on the F envelope protein of RSV virus (and in particular antigenic site IV-VI of the F envelope protein of RSV virus, more in particular at least amino acid residues 423-436 of the F envelope protein of RSV virus) and/or (ii) it competes with 101F for binding to the F envelope protein of RSV virus.

Aspect P-11: Method according to any of aspects P-4 to P-7 and P-10, wherein in step b), the set, collection or library of nucleic acid sequences is screened for nucleic acid sequences that encode (i) an amino acid sequence that can bind to and/or has affinity for the Synagis® binding site on the F envelope protein of RSV virus (and in particular antigenic site II of the F envelope protein of RSV virus, more in particular at least amino acid residues 250-275 of the F envelope protein of RSV virus) and/or (ii) an amino acid sequence that can compete with Synagis® for binding to the F envelope protein of RSV virus.

Aspect P-12: Method according to any of aspects P-4 to P-7, wherein the first amino acid sequence used in step a) is preferably such that (i) it can bind to and/or has affinity for the sialic acid binding site on the hemagglutinin H5 envelope protein of influenza virus and/or (ii) it competes with sialic acid for binding to the hemagglutinin H5 envelope protein of influenza virus.

Aspect P-13: Method according to any of aspects P-4 to P-7, wherein the first amino acid sequence used in step a) is preferably such that (i) it can bind to and/or has affinity for the VN04-2 binding site on the hemagglutinin H5 envelope protein of influenza virus and/or (ii) it competes with VN04-2 for binding to the hemagglutinin H5 envelope protein of influenza virus.

Aspect P-14: Method according to any of aspects P-4 to P-7, wherein the first amino acid sequence used in step a) is preferably such that (i) it can bind to and/or has affinity for the MAb C179 binding site on the hemagglutinin H5 envelope protein of influenza virus and/or (ii) it competes with MAb C179 for binding to the hemagglutinin H5 envelope protein of influenza virus.

Aspect P-15: Method according to any of aspects P-4 to P-7, wherein the first amino acid sequence used in step a) is preferably such that (i) it can bind to and/or has affinity for the MAb 8-2 binding site on the G envelope protein of rabies virus and/or (ii) it competes with MAb 8-2 for binding to the G envelope protein of rabies virus.

Aspect P-16: Method according to any of aspects P-4 to P-15, wherein the screening in step b) is performed in a single step.

Aspect P-17: Method according to any of aspects P-4 to P-15, wherein the screening in step b) is performed in subsequent steps.

Aspect P-18: Method according to any of aspects P-4 to P-17, wherein the screening in step b) is performed in the presence of Synagis®, 101F, sialic acid, VN04-2, MAb C179 and/or MAb 8-2.

Aspect P-19: Method for screen for suitable and/or optimal linker lengths for linking a first and a second amino acid sequence in a biparatopic or triparatopic construct according to any of aspects L-38 to L-123 or L-157 to L-236, wherein said method comprises at least the steps of:

a. providing a set, collection or library of nucleic acid sequences, in which each nucleic acid sequence in said set, collection or library encodes a fusion protein that comprises a first amino acid sequence that can bind to and/or has affinity for a first antigenic determinant, part, domain or epitope on a viral envelope protein that is fused via a linker sequence to a second amino acid sequence that has can bind to and/or has affinity for a second antigenic determinant, part, domain or epitope on the viral envelope protein (which may be the same or different as the first antigenic determinant, part, domain or epitope on the viral envelope protein), in which essentially each nucleic acid sequence (or most of these) encodes a fusion protein with a different linker sequence so as to provide a set, collection or library encoding different fusion proteins;
b. screening said set, collection or library of nucleic acid sequences for nucleic acid sequences that encode an amino acid sequence that can bind to and/or has affinity for the first and second antigenic determinant, part, domain or epitope on the viral envelope protein;

and c. isolating the nucleic acid sequences that encode an amino acid sequence that can bind to and/or has affinity for the first and second antigenic determinant, part, domain or epitope on the viral envelope protein, optionally followed by expressing the encoded amino acid sequence.

Aspect P-20: Method according to aspect P-19, wherein the first amino acid sequence is an amino acid sequence that can bind to and/or has affinity for the Synagis® binding site on the F envelope protein of RSV virus (and in particular antigenic site II of the F envelope protein of RSV virus, more in particular at least amino acid residues 250-275 of the F envelope protein of RSV virus) and/or that can compete with Synagis® for binding to the F envelope protein of RSV virus.

Aspect P-21: Method according to aspect P-20, wherein the second amino acid sequence is an amino acid sequence that can bind to and/or has affinity for the 101F binding site on the F envelope protein of RSV virus (and in particular antigenic site IV-VI of the F envelope protein of RSV virus, more in particular at least amino acid residues 423-436 of the F envelope protein of RSV virus) and/or that can compete with 101F for binding to the F envelope protein of RSV virus.

Aspect P-22: Method according to aspect P-19, wherein the first amino acid sequence is an amino acid sequence that can bind to and/or has affinity for the 101F binding site on the F envelope protein of RSV virus (and in particular antigenic site IV-VI of the F envelope protein of RSV virus, more in particular at least amino acid residues 423-436 of the F envelope protein of RSV virus) and/or that can compete with 101F for binding to the F envelope protein of RSV virus.

Aspect P-23: Method according to aspect P-22, wherein the second amino acid sequence is an amino acid sequence that can bind to and/or has affinity for the Synagis® binding site on the F envelope protein of RSV virus (and in particular antigenic site II of the F envelope protein of RSV virus, more in particular at least amino acid residues 250-275 of the F envelope protein of RSV virus) and/or that can compete with Synagis® for binding to the F envelope protein of RSV virus.

Aspect P-24: Method according to aspect P-19, wherein the first amino acid sequence is an amino acid sequence that can bind to and/or has affinity for the sialic acid binding site on the hemagglutinin H5 envelope protein of influenza virus and/or that can compete with sialic acid for binding to the hemagglutinin H5 envelope protein of influenza virus.

Aspect P-25: Method according to aspect P-19, wherein the first amino acid sequence is an amino acid sequence that can bind to and/or has affinity for the VN04-2 binding site on the hemagglutinin H5 envelope protein of influenza virus and/or that can compete with VN04-2 for binding to the hemagglutinin H5 envelope protein of influenza virus.

Aspect P-26: Method according to aspect P-19, wherein the first amino acid sequence is an amino acid sequence that can bind to and/or has affinity for the MAb C179 binding site on the hemagglutinin H5 envelope protein of influenza virus and/or that can compete with MAb C179 for binding to the hemagglutinin H5 envelope protein of influenza virus.

Aspect P-27: Method according to aspect P-19, wherein the first amino acid sequence is an amino acid sequence that can bind to and/or has affinity for the MAb 8-2 binding site on the G envelope protein of rabies virus and/or that can compete with MAb 8-2 for binding to the G envelope protein of rabies virus.

Aspect P-28: Method according to any of aspects P-19 to P-27, wherein the screening in step b) is performed in a single step.

Aspect P-29: Method according to any of aspects P-19 to P-27, wherein the screening in step b) is performed in subsequent steps.

Aspect P-30: Method according to any of aspects P-19 to P-29, wherein the screening in step b) is performed in the presence of Synagis®, 101F, sialic acid, VN04-2, MAb C179 and/or MAb 8-2.

Aspect P-31: Method for preparing and/or generating biparatopic or triparatopic constructs according to any of aspects L-38 to L-123 or L-157 to L-236, said method comprising at least the steps of:

a. providing a set, collection or library of nucleic acid sequences encoding amino acid sequences;
b. screening said set, collection or library of nucleic acid sequences for a set, collection or library of nucleic acid sequences that encode an amino acid sequence that can bind to and/or has affinity for a viral envelope protein;

c. ligating said set, collection or library of nucleic acid sequences that encode an amino acid sequence that can bind to and/or has affinity for the viral envelope protein to another nucleic acid sequence that encodes an amino acid sequence that can bind to and/or has affinity for the viral envelope protein (e.g. a nucleic acid sequence that encodes an amino acid sequence that competes with Synagis® for binding the viral envelope protein);

and d. from the set, collection or library of nucleic acid sequences obtained in c), isolating the nucleic acid sequences encoding a biparatopic amino acid sequence that can bind to and/or has affinity for the viral envelope protein (and e.g. further selecting for nucleic acid sequences that encode a biparatopic amino acid sequence that antagonizes with higher potency compared to the monovalent amino acid sequences), followed by expressing the encoded amino acid sequence.

Aspect P-32: Method for preparing and/or generating biparatopic or triparatopic constructs according to any of aspects L-38 to L-123 or L-157 to L-236, said method comprising at least the steps of:

a. providing a first set, collection or library of nucleic acid sequences encoding amino acid sequences;

b. screening said first set, collection or library of nucleic acid sequences for a nucleic acid sequence that encodes an amino acid sequence that can bind to and/or has affinity for a first antigenic determinant, part, domain or epitope on a viral envelope protein;

c. ligating the nucleic acid sequence encoding said amino acid sequence that can bind to and/or has affinity for a first antigenic determinant, part, domain or epitope on the viral envelope protein obtained in b) to another set, collection or library of nucleic acid sequences encoding amino acid sequences to obtain a set, collection or library of nucleic acid sequences that encode fusion proteins;

d. screening said set, collection or library of nucleic acid sequences obtained in step c) for a nucleic acid sequence that encodes an amino acid sequence that can bind to and has affinity for a second antigenic determinant, part, domain or epitope on the viral envelope protein which is the same or different from the first antigenic determinant, part, domain or epitope on the viral envelope protein;

and e. isolating the nucleic acid sequence that encodes an amino acid sequence that can bind to and/or has affinity for the first and second antigenic determinant, part, domain or epitope on the viral envelope protein, optionally followed by expressing the encoded amino acid sequence.

Aspect P-33: Method according to aspect P-32, wherein in step b), the set, collection or library of nucleic acid sequences is screened for nucleic acid sequences that encode a first amino acid sequence that (i) can bind to and/or has affinity for the Synagis® binding site on the F envelope protein of RSV virus (and in particular antigenic site II of the F envelope protein of RSV virus, more in particular at least amino acid residues 250-275 of the F envelope protein of RSV virus) and/or (ii) competes with Synagis® for binding to the F envelope protein of RSV virus.

Aspect P-34: Method according to any of aspects P-32 and/or P-33 wherein in step d), the set, collection or library of nucleic acid sequences is screened for nucleic acid sequences that encode a second amino acid sequence that (i) can bind to and/or has affinity for the 101F binding site on the F envelope protein of RSV virus (and in particular antigenic site IV-VI of the F envelope protein of RSV virus, more in particular at least amino acid residues 423-436 of the F envelope protein of RSV virus) and/or (ii) competes with 101F for binding to the F envelope protein of RSV virus.

Aspect P-35: Method according to aspect P-32, wherein in step b), the set, collection or library of nucleic acid sequences is screened for nucleic acid sequences that encode a first amino acid sequence that (i) can bind to and/or has affinity for the 101F binding site on the F envelope protein of RSV virus (and in particular antigenic site IV-VI of the F envelope protein of RSV virus, more in particular at least amino acid residues 423-436 of the F envelope protein of RSV virus) and/or (ii) competes with 101F for binding to the F envelope protein of RSV virus.

Aspect P-36: Method according to any of aspects P-32 and/or P-35, wherein in step d), the set, collection or library of nucleic acid sequences is screened for nucleic acid sequences that encode a second amino acid sequence that (i) can bind to and/or has affinity for the Synagis® binding site on the F envelope protein of RSV virus (and in particular antigenic site II of the F envelope protein of RSV virus, more in particular at least amino acid residues 250-275 of the F envelope protein of RSV virus) and/or (ii) competes with Synagis® for binding to the F envelope protein of RSV virus.

Aspect P-37: Method according to aspect P-32, wherein in step b), the set, collection or library of nucleic acid sequences is screened for nucleic acid sequences that encode a first amino acid sequence that (i) can bind to and/or has affinity for the sialic acid binding site on the hemagglutinin H5 envelope protein of influenza virus and/or (ii) competes with sialic acid for binding to the hemagglutinin H5 envelope protein of influenza virus.

Aspect P-38: Method according to aspect P-32, wherein in step b), the set, collection or library of nucleic acid sequences is screened for nucleic acid sequences that encode a first amino acid sequence that (i) can bind to and/or has affinity for the VN04-2 binding site on the hemagglutinin H5 envelope protein of influenza virus and/or (ii) competes with VN04-2 for binding to the hemagglutinin H5 envelope protein of influenza virus.

Aspect P-39: Method according to aspect P-32, wherein in step b), the set, collection or library of nucleic acid sequences is screened for nucleic acid sequences that encode a first amino acid sequence that (i) can bind to and/or has affinity for the MAb C179 binding site on the hemagglutinin H5 envelope protein of influenza virus and/or (ii) competes with MAb C179 for binding to the hemagglutinin H5 envelope protein of influenza virus.

Aspect P-40: Method according to aspect P-32, wherein in step b), the set, collection or library of nucleic acid sequences is screened for nucleic acid sequences that encode a first amino acid sequence that (i) can bind to and/or has affinity for the MAb 8-2 binding site on the G envelope protein of rabies virus and/or (ii) competes with MAb 8-2 for binding to the G envelope protein of rabies virus.

Aspect P-41: Method according to any of aspects P-32 to P-40, wherein the screening in steps b) and/or d) is performed in the presence of Synagis®, 101F, sialic acid, VN04-2, MAb C179 and/or MAb 8-2.

Aspect P-42: Method for preparing and/or generating a bivalent or trivalent construct according to any of aspects L-38 to L-123 or L-157 to L-236, said method comprising at least the steps of linking two or more monovalent amino acid sequences or monovalent construct according to any of aspects G-1 to G-32 and for example one or more linkers.

Aspect P-43: Method according to aspect P-42, comprising the steps of:

a. linking two or more nucleic acid sequences according to aspect M-1, encoding a monovalent construct according to any of aspects G-1 to G-32 (and also for example nucleic acids encoding one or more linkers and further one or more further elements of genetic constructs known per se) to obtain a genetic construct according to aspect M-2;

b. expressing, in a suitable host cell or host organism or in another suitable expression system, the genetic construct obtained in a)

optionally followed by:

c. isolating and/or purifying the biparatopic or triparatopic construct according to any of aspects L-38 to L-123 or L-157 to L-236 thus obtained.

Aspect Q-1: Method for screening amino acid sequences directed against an envelope protein of a virus, said method comprising at least the steps of:

a. providing a set, collection or library of nucleic acid sequences encoding amino acid sequences;

b. screening said set, collection or library of nucleic acid sequences for nucleic acid sequences that encode an amino acid sequence that can bind to and/or has affinity for an envelope protein of a virus and that is cross-blocked or is cross blocking a NANOBODY® ($V_{HH}$ sequence) of the invention, e.g. one of SEQ ID NO: 126 to 407, 2431 to 2448, 2574 to 2581, 2682 to 2717 and 3064 to 3128 (Table A-1), or a humanized variant of a NANOBODY® ($V_{HH}$ sequence) of the invention, e.g. a humanized variant of one of SEQ ID NO: 126 to 407, 2431 to 2448, 2574 to 2581, 2682 to 2717 and 3064 to 3128 (Table A-1), or a polypeptide or construct comprising at least one NANOBODY® ($V_{HH}$ sequence) of the invention, e.g. a polypeptide or construct comprising at least one of SEQ ID NO: 126 to 407, 2431 to 2448, 2574 to 2581, 2682 to 2717 and 3064 to 3128 (see Table A-1); and c. isolating said nucleic acid sequence, followed by expressing said amino acid sequence.

Aspect R-1: Method for the prevention and/or treatment of at least one viral disease, said method comprising administering, to a subject in need thereof, a pharmaceutically active amount of at least one amino acid sequence according to any of aspects A-1 to A-109, B-1 to B-28, C-1 to C-16, D-1 to D-6, E-1 to E-14 and/or F-1 to F-47, NANOBODY® ($V_{HH}$ sequence) according to any of aspects H-1 to H-137, polypeptide according to any of aspects K-1 to K-19, compound or construct according to any of aspects L-1 to L-262, monovalent construct according to any of aspects G-1 to G-32 and/or composition according to aspects O-1 to O-3.

Aspect R-2: Method for the prevention and/or treatment of at least one disease or disorder that is associated with viral entry and/or viral replication and/or mediated by an envelope protein of a virus and/or its viral receptor, with its biological or pharmacological activity, and/or with the viral-mediated biological pathways in which an envelope protein of a virus and/or its viral receptor is involved, said method comprising administering, to a subject in need thereof, a pharmaceutically active amount of at least one amino acid sequence according to any of aspects A-1 to A-109, B-1 to B-28, C-1 to C-16, D-1 to D-6, E-1 to E-14 and/or F-1 to F-47, NANOBODY® ($V_{HH}$ sequence) according to any of aspects H-1 to H-137, polypeptide according to any of aspects K-1 to K-19, compound or construct according to any of aspects L-1 to L-262, monovalent construct according to any of aspects G-1 to G-32 and/or composition according to aspects O-1 to O-3.

Aspect R-3: Method for the prevention and/or treatment of at least one disease or disorder that can be prevented and/or treated by administering, to a subject in need thereof, an amino acid sequence according to any of aspects A-1 to A-109, B-1 to B-28, C-1 to C-16, D-1 to D-6, E-1 to E-14 and/or F-1 to F-47, a NANOBODY® ($V_{HH}$ sequence) according to any of aspects H-1 to H-137, a polypeptide according to any of aspects K-1 to K-19, a compound or construct according to any of aspects L-1 to L-262, a monovalent construct according to any of aspects G-1 to G-32 and/or a composition according to aspects O-1 to O-3, said method comprising administering, to a subject in need thereof, a pharmaceutically active amount of at least one amino acid sequence according to any of aspects A-1 to A-109, B-1 to B-28, C-1 to C-16, D-1 to D-6, E-1 to E-14 and/or F-1 to F-47, NANOBODY® ($V_{HH}$ sequence) according to any of aspects H-1 to H-137, polypeptide according to any of aspects K-1 to K-19, compound or construct according to any of aspects L-1 to L-262, monovalent construct according to any of aspects G-1 to G-32 and/or composition according to aspects O-1 to O-3.

Aspect R-4: Method for immunotherapy, said method comprising administering, to a subject in need thereof, a pharmaceutically active amount of at least one amino acid sequence according to any of aspects A-1 to A-109, B-1 to B-28, C-1 to C-16, D-1 to D-6, E-1 to E-14 and/or F-1 to F-47, NANOBODY® ($V_{HH}$ sequence) according to any of aspects H-1 to H-137, polypeptide according to any of aspects K-1 to K-19, compound or construct according to any of aspects L-1 to L-262, monovalent construct according to any of aspects G-1 to G-32 and/or composition according to aspects O-1 to O-3.

Aspect R-5: Use of an amino acid sequence according to any of aspects A-1 to A-109, B-1 to B-28, C-1 to C-16, D-1 to D-6, E-1 to E-14 and/or F-1 to F-47, a NANOBODY® ($V_{HH}$ sequence) according to any of aspects H-1 to H-137, a polypeptide according to any of aspects K-1 to K-19, a compound or construct according to any of aspects L-1 to L-262, a monovalent construct according to any of aspects G-1 to G-32 and/or a composition according to aspects O-1 to O-3 in the preparation of a pharmaceutical composition for prevention and/or treatment of at least one viral disease; and/or for use in one or more of the methods according to aspects R-1 to R-4.

Aspect S-1: Part or fragment of an amino acid sequence according to any of aspects A-1 to A-109, B-1 to B-28, C-1 to C-16, D-1 to D-6, E-1 to E-14 and/or F-1 to F-47 or of a NANOBODY® ($V_{HH}$ sequence) according to any of aspects H-1 to H-137.

Aspect S-2: Part or fragment according to aspect S-1, that can specifically bind to an envelope protein of a virus.

Aspect S-3: Part or fragment according to aspect S-2, wherein said part or fragment modulates the interaction between said envelope protein and at least one binding partner.

Aspect S-4: Part or fragment according to aspects S-2 or S-3, wherein said part or fragment inhibits and/or prevents the interaction between said envelope protein and at least one binding partner.

Aspect S-5: Part or fragment according to any of aspects S-2 to S-4, wherein said part or fragment competes with said binding partner for binding to said envelope protein.

Aspect S-6: Part or fragment according to aspect S-4, wherein said at least one binding partner is a viral receptor for an envelope protein of a virus.

Aspect S-7: Part or fragment according to aspect S-6, wherein said viral receptor is chosen from the group consisting of sialic acid, soluble (2,3)-sialic acid, (2,6)-sialic acid, CD4, CCR5, CXCR4, galactosylceramide, ACE2, HveA, CD155, ICAM-1, CAR, αv integrins, heparin sulphate proteoglycans, JAM-1, the Nicotinic Acetylcholine Receptor (AchR), and the Nueral Cell Adhesion Molecule (NCAM).

Aspect S-8: Part or fragment according to aspects S-6 or S-7, wherein said interaction between an envelope protein and a viral receptor is chosen from the group consisting of the interaction between HA of influenza A virus and sialic acid and/or (2,3) sialic acid and/or (2,6) sialic acid; the interaction between gp120 of HIV-1 virus and CD4 and/or CCR5 and/or CXCR4 and/or galactosylceramide; the interaction between S1 of SARS coronavirus and ACE2; the interaction between gD and/or gB and/or gC and/or the heterodimer gH/gL of herpes simplex 1 virus and HveA; the interaction between VP1 and/or VP2 and/or VP3 of poliovirus 1 with CD155; the interaction between VP1 and/or VP2 and/or VP3 of rhinovirus 3 with ICAM-1; the interaction of adenovirus 2 fibre with CAR; the interaction of adenovirus 2 penton base with αv integrins and/or sialic acid and/or (2,3) sialic acid and/or (2,6) sialic acid and/or heparin sulphate proteoglycans, the interaction between σ1 of reovirus 1 and JAM-1 and/or sialic acid and/or (2,3) sialic acid and/or (2,6) sialic acid, the interaction between G-protein of rabies virus and the Nicotinic Acetylcholine Receptor (AchR) and/or the Nueral Cell Adhesion Molecule (NCAM).

Aspect S-9: Part or fragment according to aspect S-4, wherein said at least one binding partner is a monoclonal antibody that is directed against and/or specifically binds to said envelope protein of a virus.

Aspect S-10: Part or fragment according to aspect S-9, wherein said monoclonal antibody is Synagis®, 101F, VN04-2, MAb C179 or MAb 8-2.

Aspect S-11: Part or fragment according to any of aspects S-2 to S-10, wherein said envelope protein is a viral-specific protein.

Aspect S-12: Part or fragment according to any of aspects S-2 to S-11, wherein said envelope protein is a membrane protein.

Aspect S-13: Part or fragment according to any of aspects S-2 to S-12, wherein said envelope protein is a non-glycosylated protein.

Aspect S-14: Part or fragment according to any of aspects S-2 to S-12, wherein said envelope protein is a glycoprotein.

Aspect S-15: Part or fragment according to any of aspects S-2 to S-14, wherein said envelope protein is a viral attachment protein.

Aspect S-16: Part or fragment according to aspect S-15, wherein said viral attachment protein is chosen from the group consisting of the G protein of RSV virus, the HA protein of influenza A virus, the gp120 protein of HIV-1 virus, the S1 protein of SARS Corona virus, the gD protein of Herpes simplex 1 virus, the VP1 and/or VP2 and/or VP3 proteins of Poliovirus 1, the VP1 and/or VP2 and/or VP3 proteins of Rhinovirus 3, fibre and/or penton base of Adenovirus 2 and σ1 of Reovirus 1.

Aspect S-17: Part or fragment according to any of aspects S-2 to S-16, wherein said envelope protein is a viral fusion protein.

Aspect S-18: Part or fragment according to aspect S-17, wherein said viral fusion protein is chosen from the group consisting of the F protein of RSV virus, the HA protein of Influenza A virus, the HEF protein of influenza C virus, the 5 F protein of Simian parainfluenza virus, the F protein of Human parainfluenza virus, the F protein of Newcastle disease virus, the F2 protein of measles, the F2 protein of Sendai virus, the gp2 protein of Ebola virus, the TM protein of Moloney murine leukemia virus, the gp41 protein of Human immunodeficiency virus 1, the gp41 protein of Simian immunodeficiency virus, the gp21 protein of Human T cell leukemia virus 1, the TM protein of Human syncytin-2, the TM protein of Visna virus, the S2 protein of Mouse hepatitis virus, the E2 protein of SARS corona virus, the E protein of Tick-borne encephalitis virus, the E2 protein of Dengue 2 and 3 virus, the E protein of Yellow Fever virus, the E protein of West Nile virus, the E1 protein of Semliki forest virus, the E1 protein of Sindbis virus, the G protein of Rabies virus, the G protein of Vesicular stomatitis virus and the gB protein of Herpes simplex virus.

Aspect S-19: Part or fragment according to any of aspects S-2 to S-18, wherein said envelope protein is a viral attachment protein and a viral fusion protein.

Aspect S-20: Part or fragment according to aspect S-19, wherein said viral attachment protein and viral fusion protein is chosen from the group consisting of the HA protein of influenza A virus, the E2 protein of SARS corona virus, the E protein of Tick-borne encephalitis virus, the E2 protein of Dengue 2 and 3 virus, the E protein of Yellow Fever virus, the E protein of West Nile virus, the E1 protein of Semliki forest virus, and the E1 protein of Sindbis virus.

Aspect S-21: Part or fragment according to any of aspects S-17 to S-20, wherein said viral fusion protein is characterized by a pre-fusion conformational state and/or an intermediate conformational state and/or a post-fusion conformational state.

Aspect S-22: Part or fragment according to aspect S-21, wherein said viral fusion protein is characterized by a pre-fusion conformational state, which is a fusion protein trimer.

Aspect S-23: Part or fragment according to aspect S-22, wherein said fusion protein trimer is a trimer of hairpins.

Aspect S-24: Part or fragment according to aspects S-22 or S-23, wherein said fusion protein trimer is a six-helix bundle.

Aspect S-25: Part or fragment according to any of aspects S-22 to S-24, wherein said fusion protein is chosen from the group consisting of Influenza A virus HA protein, Influenza C virus HEF protein, Simian parainfluenza virus 5 F protein, Human parainfluenza virus F protein, Newcastle disease virus F protein, Human respiratory syncytial virus F protein, Measles F2 protein, Sendai F2 protein, Ebola virus gp2 protein, Moloney murine leukemia virus TM protein, Human immunodeficiency virus 1 gp41 protein, Simian immunodeficiency virus gp41 protein, Human T cell leukemia virus 1 gp21 protein, Human syncytin-2 TM protein, Visna virus TM protein, Mouse hepatitis virus S2 protein, SARS corona virus E2 protein.

Aspect S-26: Part or fragment according to aspect S-25, wherein said fusion protein is Influenza A virus HA protein.

Aspect S-27: Part or fragment according to aspect S-25, wherein said fusion protein is Human respiratory syncytial virus F protein.

Aspect S-28: Part or fragment according to aspect S-21, wherein said fusion protein is characterized by a pre-fusion conformational state, which is a protein dimer.

Aspect S-29: Part or fragment according to aspect S-28, wherein said dimer is a fusion protein homodimer.

Aspect S-30: Part or fragment according to aspect S-28, wherein said dimer is a protein heterodimer.

Aspect S-31: Part or fragment according to aspect S-21, wherein said fusion protein is characterized by a pre-fusion conformational state, which is a fusion protein monomer.

Aspect S-32: Part or fragment according to any of aspects S-28 to S-31, wherein said fusion protein is chosen from the group consisting of Tick-borne encephalitis virus E protein, Dengue 2 and 3 virus E2 protein, yellow fever E protein, West Nile virus E protein, Semliki forest virus E1 protein and Sindbis E1 protein.

Aspect S-33: Part or fragment according to aspect S-21, wherein said fusion protein is characterized by a post-fusion conformational state, which is a fusion protein trimer.

Aspect S-34: Part or fragment according to aspect S-33, wherein said fusion protein trimer is a trimer of hairpins.

Aspect S-35: Part or fragment according to aspects S-33 or S-34, wherein said fusion protein trimer is a six-helix bundle.

Aspect S-36: Part or fragment according to aspect S-34, wherein said trimer of hairpins comprises an α-helical coiled coil.

Aspect S-37: Part or fragment according to any of aspects S-33 to S-36, wherein said fusion protein is chosen from the group consisting of Influenza A virus HA protein, Influenza C virus HEF protein, Simian parainfluenza virus 5 F protein, Human parainfluenza virus F protein, Newcastle disease virus F protein, Respiratory syncytial F protein, Measles F2 protein, Sendai F2 protein, Ebola virus gp2 protein, Moloney murine leukemia virus TM protein, Human immunodeficiency virus 1 gp41 protein, Simian immunodeficiency virus gp41 protein, Human T cell leukemia virus 1 gp21 protein, Human syncytin-2 TM protein, Visna virus TM protein, Mouse hepatitis virus S2 protein and SARS corona virus E2 protein.

Aspect S-38: Part or fragment according to aspect S-34, wherein said trimer of hairpins comprises β-structures.

Aspect S-39: Part or fragment according to any of aspects S-33 to S-35 and S-38, wherein said fusion protein is chosen from the group consisting of Tick-borne encephalitis virus E protein, Dengue 2 and 3 virus E2 protein, yellow fever E protein, West Nile virus E protein, Semliki forest virus E1 protein and Sindbis E1 protein.

Aspect S-40: Part or fragment according to any of aspects S-34, S-36 and S-38, wherein said trimer of hairpins comprises an α-helical coiled coil and β-structures.

Aspect S-41: Part or fragment according to aspect S-40, wherein said fusion protein is chosen from the group consisting of vesicular stomatitis virus G protein, Rabies virus G protein and Herpes simplex virus gB protein.

Aspect S-42: Part or fragment according to aspect S-41, wherein said fusion protein is Rabies virus G protein.

Aspect S-43: Part or fragment according to any of aspects S-21 to S-42, wherein said part or fragment is directed against and/or can specifically bind to the pre-fusion conformational state and/or the intermediate conformational state and/or the post-fusion conformational state of said fusion protein.

Aspect S-44: Part or fragment according to aspect S-43, wherein said part or fragment is directed against and/or can specifically bind to the pre-fusion conformational state and/or the intermediate conformational state of said fusion protein.

Aspect S-45: Part or fragment according to aspect S-43, wherein said part or fragment is directed against and/or can specifically bind to the intermediate conformational state and/or the post-fusion conformational state of said fusion protein.

Aspect S-46: Part or fragment according to aspect S-43, wherein said part or fragment is directed against and/or can specifically bind to the pre-fusion conformational state and/or the post-fusion conformational state of said fusion protein.

Aspect S-47: Part or fragment according to any of aspects S-21 to S-46, wherein said epitope is located in a cavity or cleft formed by said trimer according to claims S-22 to S-27 and S-33 to S-42 or formed by said dimer according to aspects S-28 to S-32.

Aspect S-48: Part or fragment according to any of aspects S-21 to S-47, wherein said epitope is located in the stem region of said fusion protein.

Aspect S-49: Part or fragment according to aspect S-48, wherein said epitope that is located in the stem region of said fusion protein is chosen from the group consisting of an epitope that is located in the region comprising one or more of the amino acids 318 to 322 of the HA1 subunit of influenza HA and/or the region comprising one or more of the amino acids 47 to 58 of the HA2 subunit of influenza HA, an epitope that is located in the N-terminal region comprising one or more of the amino acids 1 to 38 of the HA2 subunit of influenza HA, an epitope that is located in the region comprising one or more of the amino acids 38 to 112 of the HA2 subunit of influenza HA, an epitope that is located in the region comprising one or more of the amino acids 125 to 175 of the HA2 subunit of influenza HA and an epitope that is located in the region comprising one or more of the amino acids 176 to 185 of the HA2 subunit of influenza HA.

Aspect S-50: Part or fragment according to any of aspects S-21 to S-47, wherein said epitope is located in the neck region of said fusion protein.

Aspect S-51: Part or fragment according to any of aspects S-21 to S-47, wherein said epitope is located in the globular head region of said fusion protein.

Aspect S-52: Part or fragment according to aspect S-51, wherein said globular head region comprises a β-barrel-type structure.

Aspect S-53: Part or fragment according to aspect S-51, wherein said globular head region comprises an immunoglobulin-type β-sandwich domain and a β-sheet domain.

Aspect S-54: Part or fragment according to any of aspects S-2 to S-53, wherein said epitope is chosen from the group consisting of an epitope that is located in the region comprising the A-antigenic site and/or amino acids 255 to 280 of the F-protein of RSV virus, an epitope that is located in the region comprising the Fla site and/or the region comprising amino acid 389 of the F-protein of RSV virus, an epitope that is located in the region comprising amino acids 422 to 438 of the F-protein of RSV virus, an epitope that is located in the region comprising the sialic acid binding site of the H5 HA envelope protein of influenza virus, an epitope that is located in the region comprising the Nicotinic Acetylcholine Receptor (AchR) and/or the Nueral Cell Adhesion Molecule (NCAM) binding site of the G-protein of rabies virus, an epitope that is located in the C-terminal region of a fusion protein, an epitope that is located in the N-terminal domain of a fusion protein, an epitope that is located in or comprises the fusion peptide of a fusion protein, an epitope that is located in the transmembrane domain of a fusion protein, an epitope that is located in a α-helical coiled-coil of a fusion protein, an epitope that is located in a β-structure of a fusion protein, an epitope that is located in Domain I of a fusion protein, an epitope that is located in Domain II of a fusion protein and an epitope that is located in Domain III of a fusion protein.

Aspect S-55: Part or fragment according to aspect S-54, wherein said epitope that is located in Domain II of a fusion protein is an epitope that is located in the fusion peptide of Domain II of a fusion protein.

Aspect S-56: Part or fragment according to aspect S-54, wherein said epitope that is located in Domain III of a fusion protein is chosen from the group consisting of an epitope that is located in the stem region at the C-terminus of Domain III of a fusion protein and an epitope that is located in the transmembrane anchor at the C-terminus of Domain III of a fusion protein.

Aspect S-57: Part or fragment according to any of aspects S-2 to S-56, wherein said virus is chosen from the group consisting of a DNA virus, an RNA virus and a Reverse Transcriptase (RT) virus.

Aspect S-58: Part or fragment according to aspect S-57, wherein said DNA virus is chosen from the group consisting of a ds DNA virus and a ssDNA virus.

Aspect S-59: Part or fragment according to aspect S-57, wherein said RNA virus is chosen from the group consisting of a dsRNA virus, a positive-sense ssRNA virus and a negative-sense ssRNA virus.

Aspect S-60: Part or fragment according to aspect S-57, wherein said Reverse Transcriptase (RT) virus is chosen from the group consisting of a dsDNA-RT virus and a ssRNA-RT virus.

Aspect S-61: Part or fragment according to any of aspects S-2 to S-60, wherein said virus belongs to a viral family chosen from the group consisting of Orthomyxoviridae, Paramyxoviridae, Filoviridae, Retroviridae, Coronaviridae, Togaviridae and Flaviviridae, Rhabdoviridae, Herpesviridae, Arenaviridae, Bornaviridae, Bunyaviridae, Hepadnaviridae and Poxviridae.

Aspect S-62: Part or fragment according to aspect S-61, wherein said virus belongs to a viral genus chosen from the group consisting of Alphaviruses and Flaviviruses.

Aspect S-63: Part or fragment according to any of aspects S-2 to S-62, wherein said part or fragment neutralizes said virus.

Aspect S-64: Part or fragment according to any of aspects S-2 to S-63, wherein said part or fragment modulates the infectivity of said virus.

Aspect S-65: Part or fragment according to aspect S-64, wherein said part or fragment inhibits and/or prevents the infectivity of said virus.

Aspect S-66: Part or fragment according to any of aspects S-64 or S-65, wherein said part or fragment neutralizes said virus and/or modulates, inhibits and/or prevents the infectivity of said virus in the pre-entry stage.

Aspect S-67: Part or fragment according to aspect S-66, wherein said part or fragment modulates, inhibits and/or prevents viral entry in a target host cell.

Aspect S-68: Part or fragment according to any of aspects S-2 to S-67, wherein said part or fragment induces virion aggregation of said virus.

Aspect S-69: Part or fragment according to any of aspects S-2 to S-68, wherein said part or fragment destabilizes the virion structure of said virus.

Aspect S-70: Part or fragment according to any of aspects S-2 to S-69, wherein said part or fragment inhibits virion attachment to a target host cell of said virus.

Aspect S-71: Part or fragment according to aspect S-70, wherein said part or fragment inhibits virion attachment to a target host cell of said virus by modulating the interaction between said envelope protein and a viral receptor.

Aspect S-72: Part or fragment according to aspects S-70 or S-71, wherein said part or fragment inhibits virion attachment to a target host cell of said virus by inhibiting and/or preventing the interaction between said envelope protein and a viral receptor.

Aspect S-73: Part or fragment according to aspects S-70 or S-72, wherein said part or fragment competes with said envelope protein for binding to a viral receptor.

Aspect S-74: Part or fragment according to any of aspects S-2 to S-73, wherein said part or fragment inhibits fusion of said virus with a target host cell of said virus.

Aspect S-75: Part or fragment according to aspect S-74, wherein fusion of said virus with a target host cell of said virus taking place at the target host cell membrane is inhibited.

Aspect S-76: Part or fragment according to aspect S-74, wherein fusion of said virus with a target host cell of said virus taking place within an endosomal or lysosomal compartment is inhibited.

Aspect S-77: Part or fragment according to any of aspects S-74 to S-76, wherein said part or fragment prevents said envelope protein of a virus from undergoing a conformational change.

Aspect S-78: Part or fragment according to any of aspects S-64 to S-65, wherein said part or fragment neutralizes said virus and/or modulates, inhibits and/or prevents the infectivity of said virus in the post-entry stage.

Aspect S-79: Part or fragment according to any of aspects S-2 to S-78, wherein said part or fragment modulates, inhibits and/or prevents viral replication in a target host cell.

Aspect S-80: Part or fragment according to any of aspects S-2 to S-79, wherein said part or fragment affects, inhibits and/or prevents transcription and/or translation of the viral genome.

Aspect S-81: Part or fragment according to any of aspects S-2 to S-80, wherein said part or fragment affects, inhibits and/or prevents viral packaging and/or the formation of functional virions.

Aspect S-82: Part or fragment according to any of aspects S-2 to S-81, wherein said part or fragment reduces, inhibits and/or prevents budding or release of nascent virions from a target host cell surface.

Aspect S-83: Part or fragment according to any of aspects S-2 to S-82, wherein said part or fragment is directed against and/or can specifically bind to at least two epitopes of an envelope protein of a virus.

Aspect S-84: Part or fragment according to aspect S-83, wherein said part or fragment is directed against and/or can specifically bind to at least two epitopes of one envelope protein of a virus.

Aspect S-85: Part or fragment according to any of aspects S-2 to S-83, wherein said part or fragment is directed against and/or can specifically bind to at least two epitopes of at least two envelope proteins of a virus.

Aspect S-86: Part or fragment according to any of aspects S-2 to S-83 and S-85, wherein said part or fragment is directed against and/or can specifically bind to three or more epitopes of said envelope protein of a virus.

Aspect S-87: Part or fragment according to aspect S-85, wherein said part or fragment is directed against and/or can specifically bind to three or more epitopes of at least two envelope proteins of a virus.

Aspect S-88: Part or fragment according to any of aspects S-83 to S-87, wherein said at least two or three or more epitopes are the same or are different.

Aspect S-89: Part or fragment according to any of aspects S-85 or S-87, wherein said at least two envelope proteins are the same or are different.

Aspect S-90: Part of fragment according to any of aspects S-2 to S-89, that can specifically bind to an envelope protein of a virus with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter.

Aspect S-91: Part or fragment according to any of aspects S-2 to S-90, that can specifically bind to an envelope protein of a virus with a rate of association ($k_{on}$-rate) of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$.

Aspect S-92: Part or fragment according to any of aspects S-2 to S-91, that can specifically bind to an envelope protein of a virus with a rate of dissociation ($k_{off}$ rate) between 1 $s^{-1}$ and $10^{-6}$ $s^{-1}$ preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Aspect S-93: Compound or construct, that comprises or essentially consists of one or more parts or fragments according to any of aspects S-1 to S-92, and optionally further comprises one or more other groups, residues, moieties or binding units, optionally linked via one or more linkers.

Aspect S-94: Compound or construct according to aspect S-93, in which said one or more other groups, residues, moieties or binding units are amino acid sequences.

Aspect S-95: Compound or construct according to aspects S-93 or S-94, in which said one or more linkers, if present, are one or more amino acid sequences.

Aspect S-96: Nucleic acid or nucleotide sequence, that encodes a part or fragment according to any of aspects S-1 to S-92 or a compound or construct according to any of aspects S-93 to S-95.

Aspect S-97: Composition, comprising at least one part or fragment according to any of aspects S-1 to S-92, compound or construct according to any of aspects S-93 to S-95, or nucleic acid or nucleotide sequence according to aspect S-96.

Aspect T-1: Derivative of an amino acid sequence according to any of aspects A-1 to A-109, B-1 to B-28, C-1 to C-16, D-1 to D-6, E-1 to E-14 and/or F-1 to F-47, or of a NANOBODY® ($V_{HH}$ sequence) according to any of aspects H-1 to H-137.

Aspect T-2: Derivative according to aspect T-1, that can specifically bind to an envelope protein of a virus.

Aspect T-3: Derivative according to aspects T-1 or T-2, wherein said derivative modulates the interaction between said envelope protein and at least one binding partner.

Aspect T-4: Derivative according to any of aspects T-1 to T-3, wherein said derivative inhibits and/or prevents the interaction between said envelope protein and at least one binding partner.

Aspect T-5: Derivative according to any of aspects T-1 to T-4, wherein said derivative competes with said binding partner for binding to said envelope protein.

Aspect T-6: Derivative according to aspect T-5, wherein said at least one binding partner is a viral receptor for an envelope protein of a virus.

Aspect T-7: Derivative according to aspect T-6, wherein said viral receptor is chosen from the group consisting of sialic acid, soluble (2,3)-sialic acid, (2,6)-sialic acid, CD4, CCR5, CXCR4, galactosylceramide, ACE2, HveA, CD155, ICAM-1, CAR, αv integrins, heparin sulphate proteoglycans, JAM-1, the Nicotinic Acetylcholine Receptor (AchR), and the Nueral Cell Adhesion Molecule (NCAM).

Aspect T-8: Derivative according to any of aspects T-6 or T-7, wherein said interaction between an envelope protein and a viral receptor is chosen from the group consisting of the interaction between HA of influenza A virus and sialic acid and/or (2,3) sialic acid and/or (2,6) sialic acid; the interaction between gp120 of HIV-1 virus and CD4 and/or CCR5 and/or CXCR4 and/or galactosylceramide; the interaction between S1 of SARS coronavirus and ACE2; the interaction between gD and/or gB and/or gC and/or the heterodimer gH/gL of herpes simplex 1 virus and HveA; the interaction between VP1 and/or VP2 and/or VP3 of poliovirus 1 with CD155; the interaction between VP1 and/or VP2 and/or VP3 of rhinovirus 3 with ICAM-1; the interaction of adenovirus 2 fibre with CAR; the interaction of adenovirus 2 penton base with αv integrins and/or sialic acid and/or (2,3) sialic acid and/or (2,6) sialic acid and/or heparin sulphate proteoglycans, the interaction between σ1 of reovirus 1 and JAM-1 and/or sialic acid and/or (2,3) sialic acid and/or (2,6) sialic acid, the interaction between G-protein of rabies virus and the Nicotinic Acetylcholine Receptor (AchR) and/or the Nueral Cell Adhesion Molecule (NCAM).

Aspect T-9: Derivative according to any of aspect T-4 or T-5, wherein said at least one binding partner is a monoclonal antibody that is directed against and/or specifically binds to said envelope protein of a virus.

Aspect T-10: Derivative according to aspect T-9, wherein said monoclonal antibody is Synagis®, 101F, VN04-2, MAb C179 and/or MAb 8-2.

Aspect T-11: Derivative according to any of aspects T-2 to T-10, wherein said envelope protein is a viral-specific protein.

Aspect T-12: Derivative according to any of aspects T-2 to T-10, wherein said envelope protein is a membrane protein.

Aspect T-13: Derivative according to any of aspects T-2 to T-12, wherein said envelope protein is a non-glycosylated protein.

Aspect T-14: Derivative according to any of aspects T-2 to T-12, wherein said envelope protein is a glycoprotein.

Aspect T-15: Derivative according to any of aspects T-2 to T-14, wherein said envelope protein is a viral attachment protein.

Aspect T-16: Derivative according to aspect T-15, wherein said viral attachment protein is chosen from the group consisting of the G protein of RSV virus, the HA protein of influenza A virus, the gp120 protein of HIV-1 virus, the S1 protein of SARS Corona virus, the gD protein of Herpes simplex 1 virus, the VP1 and/or VP2 and/or VP3 proteins of Poliovirus 1, the VP1 and/or VP2 and/or VP3 proteins of Rhinovirus 3, fibre and/or penton base of Adenovirus 2 and al of Reovirus 1.

Aspect T-17: Derivative according to any of aspects T-2 to T-14, wherein said envelope protein is a viral fusion protein.

Aspect T-18: Derivative according to aspect T-17, wherein said viral fusion protein is chosen from the group consisting of the F protein of RSV virus, the HA protein of Influenza A virus, the HEF protein of influenza C virus, the 5 F protein of Simian parainfluenza virus, the F protein of Human parainfluenza virus, the F protein of Newcastle disease virus, the F2 protein of measles, the F2 protein of Sendai virus, the gp2 protein of Ebola virus, the TM protein of Moloney murine leukemia virus, the gp41 protein of Human immunodeficiency virus 1, the gp41 protein of Simian immunodeficiency virus, the gp21 protein of Human T cell leukemia virus 1, the TM protein of Human syncytin-2, the TM protein of Visna virus, the S2 protein of Mouse hepatitis virus, the E2 protein of SARS corona virus, the E protein of Tick-borne encephalitis virus, the E2 protein of Dengue 2 and 3 virus, the E protein of Yellow Fever virus, the E protein of West Nile virus, the E1 protein of Semliki forest virus, the E1 protein of Sindbis virus, the G protein of Rabies virus, the G protein of Vesicular stomatitis virus and the gB protein of Herpes simplex virus.

Aspect T-19: Derivative according to any of aspects T-2 to T-18, wherein said envelope protein is a viral attachment protein and a viral fusion protein.

Aspect T-20: Derivative according to aspect T-19, wherein said viral attachment protein and viral fusion protein is chosen from the group consisting of the HA protein of influenza A virus, the E2 protein of SARS corona virus, the E protein of Tick-borne encephalitis virus, the E2 protein of Dengue 2 and 3 virus, the E protein of Yellow Fever virus, the E protein of West Nile virus, the E1 protein of Semliki forest virus, and the E1 protein of Sindbis virus.

Aspect T-21: Derivative according to aspects T-17 to T-20, wherein said viral fusion protein is characterized by a pre-fusion conformational state and/or an intermediate conformational state and/or a post-fusion conformational state.

Aspect T-22: Derivative according to aspect T-21, wherein said viral fusion protein is characterized by a pre-fusion conformational state, which is a fusion protein trimer.

Aspect T-23: Derivative according to aspect T-22, wherein said fusion protein trimer is a trimer of hairpins.

Aspect T-24: Derivative according to aspects T-22 or T-23, wherein said fusion protein trimer is a six-helix bundle.

Aspect T-25: Derivative according to any of aspects T-22 to T-24, wherein said fusion protein is chosen from the group consisting of Influenza A virus HA protein, Influenza C virus HEF protein, Simian parainfluenza virus 5 F protein, Human parainfluenza virus F protein, Newcastle disease virus F protein, Human respiratory syncytial virus F protein, Measles F2 protein, Sendai F2 protein, Ebola virus gp2 protein, Moloney murine leukemia virus TM protein, Human immunodeficiency virus 1 gp41 protein, Simian immunodeficiency virus gp41 protein, Human T cell leukemia virus 1 gp21 protein, Human syncytin-2 TM protein, Visna virus TM protein, Mouse hepatitis virus S2 protein, SARS corona virus E2 protein.

Aspect T-26: Derivative according to aspect T-25, wherein said fusion protein is Influenza A virus HA protein.

Aspect T-27: Derivative according to aspect T-25, wherein said fusion protein is Human respiratory syncytial virus F protein.

Aspect T-28: Derivative according to aspect T-21, wherein said fusion protein is characterized by a pre-fusion conformational state, which is a protein dimer.

Aspect T-29: Derivative according to aspect T-28, wherein said dimer is a fusion protein homodimer.

Aspect T-30: Derivative according to aspect T-28, wherein said dimer is a protein heterodimer.

Aspect T-31: Derivative according to aspect T-21, wherein said fusion protein is characterized by a pre-fusion conformational state, which is a fusion protein monomer.

Aspect T-32: Derivative according to any of aspects T-28 to T-31, wherein said fusion protein is chosen from the group consisting of Tick-borne encephalitis virus E protein, Dengue 2 and 3 virus E2 protein, yellow fever E protein, West Nile virus E protein, Semliki forest virus E1 protein and Sindbis E1 protein.

Aspect T-33: Derivative according to aspect T-21, wherein said fusion protein is characterized by a post-fusion conformational state, which is a fusion protein trimer.

Aspect T-34: Derivative according to aspect T-33, wherein said fusion protein trimer is a trimer of hairpins.

Aspect T-35: Derivative according to aspects T-33 or T-34, wherein said fusion protein trimer is a six-helix bundle.

Aspect T-36: Derivative according to aspect T-34, wherein said trimer of hairpins comprises an $\alpha$-helical coiled coil.

Aspect T-37: Derivative according to any of aspects T-33 to T-36, wherein said fusion protein is chosen from the group consisting of Influenza A virus HA protein, Influenza C virus HEF protein, Simian parainfluenza virus 5 F protein, Human parainfluenza virus F protein, Newcastle disease virus F protein, Respiratory syncytial F protein, Measles F2 protein, Sendai F2 protein, Ebola virus gp2 protein, Moloney murine leukemia virus TM protein, Human immunodeficiency virus 1 gp41 protein, Simian immunodeficiency virus gp41 protein, Human T cell leukemia virus 1 gp21 protein, Human syncytin-2 TM protein, Visna virus TM protein, Mouse hepatitis virus S2 protein and SARS corona virus E2 protein.

Aspect T-38: Derivative according to aspect T-34, wherein said trimer of hairpins comprises $\beta$-structures.

Aspect T-39: Derivative according to any of aspects T-33 to T-35 and T-38, wherein said fusion protein is chosen from the group consisting of Tick-borne encephalitis virus E protein, Dengue 2 and 3 virus E2 protein, yellow fever E protein, West Nile virus E protein, Semliki forest virus E1 protein and Sindbis E1 protein.

Aspect T-40: Derivative according to any of aspects T-34, T-36 and T-38, wherein said trimer of hairpins comprises an $\alpha$-helical coiled coil and $\beta$-structures.

Aspect T-41: Derivative according to aspect T-40, wherein said fusion protein is chosen from the group consisting of vesicular stomatitis virus G protein, Rabies virus G protein and Herpes simplex virus gB protein.

Aspect T-42: Derivative according to aspect T-41, wherein said fusion protein is Rabies virus G protein.

Aspect T-43: Derivative according to any of aspects T-21 to T-42, wherein said derivative is directed against and/or can specifically bind to the pre-fusion conformational state and/or the intermediate conformational state and/or the post-fusion conformational state of said fusion protein.

Aspect T-44: Derivative according to aspect T-43, wherein said derivative is directed against and/or can specifically bind to the pre-fusion conformational state and/or the intermediate conformational state of said fusion protein.

Aspect T-45: Derivative according to aspect T-43, wherein said derivative is directed against and/or can specifically bind to the intermediate conformational state and/or the post-fusion conformational state of said fusion protein.

Aspect T-46: Derivative according to aspect T-43, wherein said derivative is directed against and/or can specifically bind to the pre-fusion conformational state and/or the post-fusion conformational state of said fusion protein.

Aspect T-47: Derivative according to any of aspects T-22 to T-46, wherein said epitope is located in a cavity or cleft formed by said trimer according to claims T-22 to T-27 and T-33 to T-42 or formed by said dimer according to aspects T-28 to T-32.

Aspect T-48: Derivative according to any of aspects T-22 to T-47, wherein said epitope is located in the stem region of said fusion protein.

Aspect T-49: Derivative according to aspect T-48, wherein said epitope that is located in the stem region of said fusion protein is chosen from the group consisting of an epitope that is located in the region comprising one or more of the amino acids 318 to 322 of the HA1 subunit of influenza HA and/or the region comprising one or more of the amino acids 47 to 58 of the HA2 subunit of influenza HA, an epitope that is located in the N-terminal region comprising one or more of the amino acids 1 to 38 of the HA2 subunit of influenza HA, an epitope that is located in the region comprising one or more of the amino acids 38 to 112 of the HA2 subunit of influenza HA, an epitope that is located in the region comprising one or more of the amino acids 125 to 175 of the HA2 subunit of influenza HA and an epitope that is located in the region comprising one or more of the amino acids 176 to 185 of the HA2 subunit of influenza HA.

Aspect T-50: Derivative according to any of aspects T-22 to T-47, wherein said epitope is located in the neck region of said fusion protein.

Aspect T-51: Derivative according to any of aspects T-22 to T-47, wherein said epitope is located in the globular head region of said fusion protein.

Aspect T-52: Derivative according to aspect T-51, wherein said globular head region comprises a β-barrel-type structure.

Aspect T-53: Derivative according to aspect T-51, wherein said globular head region comprises an immunoglobulin-type β-sandwich domain and a β-sheet domain.

Aspect T-54: Derivative according to any of aspects T-2 to T-53, wherein said epitope is chosen from the group consisting of an epitope that is located in the region comprising the A-antigenic site and/or amino acids 255 to 280 of the F-protein of RSV virus, an epitope that is located in the region comprising the Fla site and/or the region comprising amino acid 389 of the F-protein of RSV virus, an epitope that is located in the region comprising amino acids 422 to 438 of the F-protein of RSV virus, an epitope that is located in the region comprising the sialic acid binding site of the H5 HA envelope protein of influenza virus, an epitope that is located in the region comprising the Nicotinic Acetylcholine Receptor (AchR) and/or the Nueral Cell Adhesion Molecule (NCAM) binding site of the G-protein of rabies virus, an epitope that is located in the C-terminal region of a fusion protein, an epitope that is located in the N-terminal domain of a fusion protein, an epitope that is located in or comprises the fusion peptide of a fusion protein, an epitope that is located in the transmembrane domain of a fusion protein, an epitope that is located in a α-helical coiled-coil of a fusion protein, an epitope that is located in a β-structure of a fusion protein, an epitope that is located in Domain I of a fusion protein, an epitope that is located in Domain II of a fusion protein and an epitope that is located in Domain III of a fusion protein.

Aspect T-55: Derivative according to aspect T-54, wherein said epitope that is located in Domain II of a fusion protein is an epitope that is located in the fusion peptide of Domain II of a fusion protein.

Aspect T-56: Derivative according to aspect T-54, wherein said epitope that is located in Domain III of a fusion protein is chosen from the group consisting of an epitope that is located in the stem region at the C-terminus of Domain III of a fusion protein and an epitope that is located in the transmembrane anchor at the C-terminus of Domain III of a fusion protein.

Aspect T-57: Derivative according to any of aspects T-2 to T-56, wherein said virus is chosen from the group consisting of a DNA virus, an RNA virus and a Reverse Transcriptase (RT) virus.

Aspect T-58: Derivative according to aspect T-57, wherein said DNA virus is chosen from the group consisting of a ds DNA virus and a ssDNA virus.

Aspect T-59: Derivative according to aspect T-57, wherein said RNA virus is chosen from the group consisting of a dsRNA virus, a positive-sense ssRNA virus and a negative-sense ssRNA virus.

Aspect T-60: Derivative according to aspect T-57, wherein said Reverse Transcriptase (RT) virus is chosen from the group consisting of a dsDNA-RT virus and a ssRNA-RT virus.

Aspect T-61: Derivative according to any of aspects T-2 to T-60, wherein said virus belongs to a viral family chosen from the group consisting of Orthomyxoviridae, Paramyxoviridae, Filoviridae, Retroviridae, Coronaviridae, Togaviridae and Flaviviridae, Rhabdoviridae, Herpesviridae, Arenaviridae, Bornaviridae, Bunyaviridae, Hepadnaviridae and Poxviridae.

Aspect T-62: Derivative according to aspect T-61, wherein said virus belongs to a viral genus chosen from the group consisting of Alphaviruses and Flaviviruses.

Aspect T-63: Derivative according to any of aspects T-2 to T-62, wherein said derivative neutralizes said virus.

Aspect T-64: Derivative according to any of aspects T-2 to T-63, wherein said derivative modulates the infectivity of said virus.

Aspect T-65: Derivative according to aspect T-64, wherein said derivative inhibits and/or prevents the infectivity of said virus.

Aspect T-66: Derivative according to any of aspects T-64 or T-65, wherein said derivative neutralizes said virus and/or modulates, inhibits and/or prevents the infectivity of said virus in the pre-entry stage.

Aspect T-67: Derivative according to aspect T-66, wherein said derivative modulates, inhibits and/or prevents viral entry in a target host cell.

Aspect T-68: Derivative according to any of aspects T-2 to T-67, wherein said derivative induces virion aggregation of said virus.

Aspect T-69: Derivative according to any of aspects T-2 to T-68, wherein said derivative destabilizes the virion structure of said virus.

Aspect T-70: Derivative according to any of aspects T-2 to T-69, wherein said derivative inhibits virion attachment to a target host cell of said virus.

Aspect T-71: Derivative according to aspect T-70 wherein said derivative inhibits virion attachment to a target host cell of said virus by modulating the interaction between said envelope protein and a viral receptor.

Aspect T-72: Derivative according to aspects T-70 or T-71, wherein said derivative inhibits virion attachment to a target host cell of said virus by inhibiting and/or preventing the interaction between said envelope protein and a viral receptor.

Aspect T-73: Derivative according to aspects T-70 to T-72, wherein said derivative competes with said envelope protein for binding to a viral receptor.

Aspect T-74: Derivative according to any of aspects T-2 to T-73, wherein said derivative inhibits fusion of said virus with a target host cell of said virus.

Aspect T-75: Derivative according to aspect T-74, wherein fusion of said virus with a target host cell of said virus taking place at the target host cell membrane is inhibited.

Aspect T-76: Derivative according to aspect T-74, wherein fusion of said virus with a target host cell of said virus taking place within an endosomal or lysosomal compartment is inhibited.

Aspect T-77: Derivative according to any of aspects T-74 to T-76, wherein said derivative prevents said envelope protein of a virus from undergoing a conformational change.

Aspect T-78: Derivative according to any of aspects T-64 or T-65, wherein said derivative neutralizes said virus and/or modulates, inhibits and/or prevents the infectivity of said virus in the post-entry stage.

Aspect T-79: Derivative according to any of aspects T-2 to T-78, wherein said derivative modulates, inhibits and/or prevents viral replication in a target host cell.

Aspect T-80: Derivative according to any of aspects T-2 to T-79, wherein said derivative affects, inhibits and/or prevents transcription and/or translation of the viral genome.

Aspect T-81: Derivative according to any of aspects T-2 to T-80, wherein said derivative affects, inhibits and/or prevents viral packaging and/or the formation of functional virions.

Aspect T-82: Derivative according to any of aspects T-2 to T-81, wherein said derivative reduces, inhibits and/or prevents budding or release of nascent virions from a target host cell surface.

Aspect T-83: Derivative according to any of aspects T-2 to T-82, wherein said derivative is directed against and/or can specifically bind to at least two epitopes of an envelope protein of a virus.

Aspect T-84: Derivative according to aspect T-83, wherein said derivative is directed against and/or can specifically bind to at least two epitopes of one envelope protein of a virus.

Aspect T-85: Derivative according to any of aspects T-2 to T-83, wherein said derivative is directed against and/or can specifically bind to at least two epitopes of at least two envelope proteins of a virus.

Aspect T-86: Derivative according to any of aspects T-2 to T-83 and T-85, wherein said derivative is directed against and/or can specifically bind to three or more epitopes of said envelope protein of a virus.

Aspect T-87: Derivative according to aspect T-86, wherein said derivative is directed against and/or can specifically bind to three or more epitopes of at least two envelope proteins of a virus.

Aspect T-88: Derivative according to any of aspects T-83 to T-87, wherein said at least two or three or more epitopes are the same or are different.

Aspect T-89: Derivative according to any of aspects T-85 or T-87, wherein said at least two envelope proteins are the same or are different.

Aspect T-90: Derivative according to any of aspects T-2 to T-89, that can specifically bind to an envelope protein of a virus with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter.

Aspect T-91: Derivative according to any of aspects T-2 to T-90, that can specifically bind to an envelope protein of a virus with a rate of association ($k_{on}$-rate) of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$.

Aspect T-92: Derivative according to any of aspects T-2 to T-91, that can specifically bind to an envelope protein of a virus with a rate of dissociation ($k_{off}$rate) between 1 $s^{-1}$ and $10^{-6}$ $s^{-1}$ preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Aspect T-93: Derivative of a compound or construct according to any of aspects L-1 to L-262 or a polypeptide according to any of aspects K-1 to K-19.

Aspect T-94: Derivative according to aspect T-93, that can specifically bind to an envelope protein of a virus.

Aspect T-95: Derivative according to any of aspects T-93 to T-94, that can specifically bind to an envelope protein of a virus with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter.

Aspect T-96: Derivative according to any of aspects T-93 to T-95, that can specifically bind to an envelope protein of a virus with a rate of association ($k_{on}$-rate) of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$.

Aspect T-97: Derivative according to any of aspects T-93 to T-96, that can specifically bind to an envelope protein of a virus with a rate of dissociation ($k_{off}$rate) between 1 $s^{-1}$ and $10^{-6}$ $s^{-1}$ preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Aspect T-98: Derivative according to any of aspects T-1 to T-97, that has a serum half-life that is at least 1.5 times, preferably at least 2 times, such as at least 5 times, for example at least 10 times or more than 20 times, greater than the half-life of the corresponding amino acid sequence according to any of aspects A-1 to A-109, B-1 to B-28, C-1 to C-16, D-1 to D-6, E-1 to E-14 and/or F-1 to F-47 per se, NANOBODY® ($V_{HH}$ sequence) according to any of aspects H-1 to H-137 per se, polypeptide according to any of aspects K-1 to K-19, compound or construct according to any of aspects L-1 to L-262 per se, or monovalent construct according to any of aspects G-1 to G-32 per se, respectively.

Aspect T-99: Derivative according to any of aspects T-1 to T-98, that has a serum half-life that is increased with more than 1 hours, preferably more than 2 hours, more preferably more than 6 hours, such as more than 12 hours, or even more than 24, 48 or 72 hours, compared to the corresponding amino acid sequence according to any of aspects A-1 to A-109, B-1 to B-28, C-1 to C-16, D-1 to D-6, E-1 to E-14 and/or F-1 to F-47 per se, NANOBODY® ($V_{HH}$ sequence) according to any of aspects H-1 to H-137 per se, polypeptide according to any of aspects K-1 to K-19, compound or construct according to any of aspects L-1 to L-262 per se, or monovalent construct according to any of aspects G-1 to G-32 per se, respectively.

Aspect T-100: Derivative according to any of aspects T-1 to T-99, that has a serum half-life in human of at least about 12 hours, preferably at least 24 hours, more preferably at least 48 hours, even more preferably at least 72 hours or more; for example, at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).

Aspect T-101: Derivative according to any of aspects T-1 to T-100, that is a pegylated derivative.

Aspect T-102: Compound or construct, that comprises or essentially consists of one or more derivatives according to any of aspects T-1 to T-101, and optionally further comprises one or more other groups, residues, moieties or binding units, optionally linked via one or more linkers.

Aspect T-103: Compound or construct according to aspect T-102, in which said one or more other groups, residues, moieties or binding units are amino acid sequences.

Aspect T-104: Compound or construct according to aspects T-102 or T-103, in which said one or more linkers, if present, are one or more amino acid sequences.

Aspect T-105: Nucleic acid or nucleotide sequence, that encodes a derivative according to any of aspects T-1 to T-101 or a compound or construct according to any of aspects T-102 to T-104.

Aspect T-106: Composition, comprising at least one derivative according to any of aspects T-1 to T-101, compound or construct according to any of aspects T-102 to T-104, or nucleic acid or nucleotide sequence according to aspect T-105.

Aspect U-1: A method for administering an effective amount of an amino acid sequence according to any of claims A-1 to A-109, B-1 to B-28, C-1 to C-16, D-1 to D-6, E-1 to E-14 and/or F-1 to F-47, a NANOBODY® ($V_{HH}$ sequence) according to any of claims H-1 to H-137, a polypeptide according to any of claims K-1 to K-19, a compound or construct according to any of claims L-1 to L-262 and/or a monovalent construct according to any of claims G-1 to G-32, directed against an envelope protein of a virus (such as an envelope protein of RSV virus, an envelope protein of influenza virus and/or an envelope protein of rabies virus) and/or a composition comprising the same, wherein said method comprises the step of administering the amino acid sequence according to any of claims A-1 to A-109, B-1 to B-28, C-1 to C-16, D-1 to D-6, E-1 to E-14 and/or F-1 to F-47, the NANOBODY® ($V_{HH}$ sequence) according to any of claims H-1 to H-137, the polypeptide according to any of claims K-1 to K-19, the compound or construct according to any of claims L-1 to L-262, the monovalent construct according to any of claims G-1 to G-32 and/or the composition comprising the same to the pulmonary tissue.

Aspect U-2: The method according to aspect U-1, wherein the amino acid sequence according to any of claims A-1 to A-109, B-1 to B-28, C-1 to C-16, D-1 to D-6, E-1 to E-14 and/or F-1 to F-47, the NANOBODY® ($V_{HH}$ sequence) according to any of claims H-1 to H-137, the polypeptide according to any of claims K-1 to K-19, the compound or construct according to any of claims L-1 to L-262, the monovalent construct according to any of claims G-1 to G-32 and/or the composition comprising the same is administered by use of an inhaler or intranasal delivery device or aerosol.

Aspect U-3: Method according to any of aspects U-1 or U-2, wherein at least 5%, preferably at least 10%, 20%, 30%, 40%, more preferably at least 50%, 60%, 70%, and even more preferably at least 80% or more of the amino acid sequence according to any of claims A-1 to A-109, B-1 to B-28, C-1 to C-16, D-1 to D-6, E-1 to E-14 and/or F-1 to F-47, the NANOBODY® ($V_{HH}$ sequence) according to any of claims H-1 to H-137, the polypeptide according to any of claims K-1 to K-19, the compound or construct according to any of claims L-1 to L-262, the monovalent construct according to any of claims G-1 to G-32 and/or the composition comprising the same is stable in the pulmonary tissue for at least 24 hours, preferably at least 48 hours more preferably at least 72 hours.

Aspect U-4: Method according to any of aspects U-1 to U-3, wherein the amino acid sequence according to any of claims A-1 to A-109, B-1 to B-28, C-1 to C-16, D-1 to D-6, E-1 to E-14 and/or F-1 to F-47, the NANOBODY® ($V_{HH}$ sequence) according to any of claims H-1 to H-137, the polypeptide according to any of claims K-1 to K-19, the compound or construct according to any of claims L-1 to L-262, the monovalent construct according to any of claims G-1 to G-32 and/or the composition comprising the same are applied in pure form, i.e., when they are liquids or a dry powder.

Aspect U-5: Method according to any of aspects U-1 to U-3, wherein the amino acid sequence according to any of claims A-1 to A-109, B-1 to B-28, C-1 to C-16, D-1 to D-6, E-1 to E-14 and/or F-1 to F-47, the NANOBODY® ($V_{HH}$ sequence) according to any of claims H-1 to H-137, the polypeptide according to any of claims K-1 to K-19, the compound or construct according to any of claims L-1 to L-262, the monovalent construct according to any of claims G-1 to G-32 and/or the composition comprising the same are administered to the pulmonary tissue as composition or formulation comprising an amino acid sequence according to any of claims A-1 to A-109, B-1 to B-28, C-1 to C-16, D-1 to D-6, E-1 to E-14 and/or F-1 to F-47, a NANOBODY® ($V_{HH}$ sequence) according to any of claims H-1 to H-137, a polypeptide according to any of claims K-1 to K-19, a compound or construct according to any of claims L-1 to L-262 and/or a monovalent construct according to any of claims G-1 to G-32 and a carrier suitable for pulmonary delivery.

Aspect U-6: Pharmaceutical composition comprising an amino acid sequence according to any of claims A-1 to A-109, B-1 to B-28, C-1 to C-16, D-1 to D-6, E-1 to E-14 and/or F-1 to F-47, a NANOBODY® ($V_{HH}$ sequence) according to any of claims H-1 to H-137, a polypeptide according to any of claims K-1 to K-19, a compound or construct according to any of claims L-1 to L-262 and/or a monovalent construct according to any of claims G-1 to G-32 and a carrier suitable for pulmonary delivery.

Aspect U-7: Pharmaceutical device suitable for the pulmonary delivery of an amino acid sequence according to any of claims A-1 to A-109, B-1 to B-28, C-1 to C-16, D-1 to D-6, E-1 to E-14 and/or F-1 to F-47, a NANOBODY® ($V_{HH}$ sequence) according to any of claims H-1 to H-137, a polypeptide according to any of claims K-1 to K-19, a compound or construct according to any of claims L-1 to L-262 and/or a monovalent construct according to any of claims G-1 to G-32 and/or suitable in the use of a composition comprising the same.

Aspect U-8: Pharmaceutical device according to aspect U-7 that is an inhaler for liquids (e.g. a suspension of fine solid particles or droplets) comprising the amino acid sequence according to any of claims A-1 to A-109, B-1 to B-28, C-1 to C-16, D-1 to D-6, E-1 to E-14 and/or F-1 to F-47, the NANOBODY® ($V_{HH}$ sequence) according to any of claims H-1 to H-137, the polypeptide according to any of claims K-1 to K-19, the compound or construct according to any of claims L-1 to L-262 and/or the monovalent construct according to any of claims G-1 to G-32.

Aspect U-9: Pharmaceutical device according to aspect U-7 that is an aerosol comprising the amino acid sequence according to any of claims A-1 to A-109, B-1 to B-28, C-1 to C-16, D-1 to D-6, E-1 to E-14 and/or F-1 to F-47, the NANOBODY® ($V_{HH}$ sequence) according to any of claims H-1 to H-137, the polypeptide according to any of claims K-1 to K-19, the compound or construct according to any of claims L-1 to L-262 and/or the monovalent construct according to any of claims G-1 to G-32.

Aspect U-10: Pharmaceutical device according to aspect U-7 that is a dry powder inhaler comprising the amino acid sequence according to any of claims A-1 to A-109, B-1 to B-28, C-1 to C-16, D-1 to D-6, E-1 to E-14 and/or F-1 to F-47, the NANOBODY® ($V_{HH}$ sequence) according to any of claims H-1 to H-137, the polypeptide according to any of claims K-1 to K-19, the compound or construct according to any of claims L-1 to L-262 and/or the monovalent construct according to any of claims G-1 to G-32 in the form of a dry powder.

Aspect U-11: Method for the prevention and/or treatment of at least one viral disease, said method comprising administering to the pulmonary tissue of a subject in need thereof, a pharmaceutically active amount of an amino acid sequence according to any of claims A-1 to A-109, B-1 to B-28, C-1 to C-16, D-1 to D-6, E-1 to E-14 and/or F-1 to F-47, a NANOBODY® ($V_{HH}$ sequence) according to any of claims H-1 to H-137, a polypeptide according to any of claims K-1 to K-19, a compound or construct according to any of claims L-1 to L-262 and/or a monovalent construct according to any of claims G-1 to G-32 and/or of a pharmaceutical composition comprising the same.

Aspect U-12: Method for the prevention and/or treatment of infection by RSV, influenza and/or rabies, said method comprising administering to the pulmonary tissue of a subject in need thereof, a pharmaceutically active amount of an amino acid sequence according to any of claims A-1 to A-109, B-1 to B-28, C-1 to C-16, D-1 to D-6, E-1 to E-14 and/or F-1 to F-47, a NANOBODY® ($V_{HH}$ sequence) according to any of claims H-1 to H-137, a polypeptide according to any of claims K-1 to K-19, a compound or construct according to any of claims L-1 to L-262 and/or a monovalent construct according to any of claims G-1 to G-32, and/or of a pharmaceutical composition comprising the same.

Aspect V-1: Method for the prevention and/or treatment of viral infection (such as e.g. infection by RSV, influenza or rabies), said method comprising administering, to a subject in need thereof, a pharmaceutically active amount of a multivalent (e.g. trivalent, bivalent, triparatopic, biparatopic, trivalent biparatopic) amino acid sequence of the invention, of a multivalent (e.g. trivalent, bivalent, triparatopic, biparatopic, trivalent biparatopic) NANOBODY® ($V_{HH}$ sequence) of the invention, of a multivalent (e.g. trivalent, bivalent, triparatopic, biparatopic, trivalent biparatopic) polypeptide of the invention, of a multivalent (e.g. trivalent, bivalent, triparatopic, biparatopic, trivalent biparatopic) compound or construct of the invention, and/or of a pharmaceutical composition comprising the same.

Aspect V-2: Use of a multivalent (e.g. trivalent, bivalent, triparatopic, biparatopic, trivalent biparatopic) amino acid sequence of the invention, of a multivalent (e.g. trivalent, bivalent, triparatopic, biparatopic, trivalent biparatopic) NANOBODY® ($V_{HH}$ sequence) of the invention, of a multivalent (e.g. trivalent, bivalent, triparatopic, biparatopic, trivalent biparatopic) polypeptide of the invention, of a multivalent (e.g. trivalent, bivalent, triparatopic, biparatopic, trivalent biparatopic) compound or construct of the invention, and/or of a pharmaceutical composition comprising the same for binding and/or neutralization of virus.

Aspect V-3: Use of a multivalent (e.g. trivalent, bivalent, triparatopic, biparatopic, trivalent biparatopic) amino acid sequence of the invention, of a multivalent (e.g. trivalent, bivalent, triparatopic, biparatopic, trivalent biparatopic) NANOBODY® ($V_{HH}$ sequence) of the invention, of a multivalent (e.g. trivalent, bivalent, triparatopic, biparatopic, trivalent biparatopic) polypeptide of the invention, of a multivalent (e.g. trivalent, bivalent, triparatopic, biparatopic, trivalent biparatopic) compound or construct of the invention, and/or of a pharmaceutical composition comprising the same for binding and/or neutralization different genotypes of a virus.

Aspect V-4: Use of a multivalent (e.g. trivalent, bivalent, triparatopic, biparatopic, trivalent biparatopic) amino acid sequence of the invention, of a multivalent (e.g. trivalent, bivalent, triparatopic, biparatopic, trivalent biparatopic) NANOBODY® ($V_{HH}$ sequence) of the invention, of a multivalent (e.g. trivalent, bivalent, triparatopic, biparatopic, trivalent biparatopic) polypeptide of the invention, of a multivalent (e.g. trivalent, bivalent, triparatopic, biparatopic, trivalent biparatopic) compound or construct of the invention, and/or of a pharmaceutical composition comprising the same for binding and/or neutralization of different subtypes of a virus.

Aspect V-5: Use of a multivalent (e.g. trivalent, bivalent, triparatopic, biparatopic, trivalent biparatopic) amino acid sequence of the invention, of a multivalent (e.g. trivalent, bivalent, triparatopic, biparatopic, trivalent biparatopic) NANOBODY® ($V_{HH}$ sequence) of the invention, of a multivalent (e.g. trivalent, bivalent, triparatopic, biparatopic, trivalent biparatopic) polypeptide of the invention, of a multivalent (e.g. trivalent, bivalent, triparatopic, biparatopic, trivalent biparatopic) compound or construct of the invention, and/or of a pharmaceutical composition comprising the same for binding and/or neutralization of different strains of a virus.

Aspect V-6: Use of a multivalent (e.g. trivalent, bivalent, triparatopic, biparatopic, trivalent biparatopic) amino acid sequence of the invention, of a multivalent (e.g. trivalent, bivalent, triparatopic, biparatopic, trivalent biparatopic) NANOBODY® ($V_{HH}$ sequence) of the invention, of a multivalent (e.g. trivalent, bivalent, triparatopic, biparatopic, trivalent biparatopic) polypeptide of the invention, of a multivalent (e.g. trivalent, bivalent, triparatopic, biparatopic, trivalent biparatopic) compound or construct of the invention, and/or of a pharmaceutical composition comprising the same for binding and/or neutralization of one or more escape mutants of a virus.

Aspect V-7: Method or use according to any of aspects V-1 to V-6, wherein the multivalent amino acid sequence, the multivalent NANOBODY® ($V_{HH}$ sequence), the multivalent polypeptide, and/or the multivalent compound or construct is bivalent.

Aspect V-8: Method or use according to any of aspects V-1 to V-7, wherein the multivalent amino acid sequence, the multivalent NANOBODY® ($V_{HH}$ sequence), the multivalent polypeptide, and/or the multivalent compound or construct is biparatopic.

Aspect V-9: Method or use according to any of aspects V-1 to V-6, wherein the multivalent amino acid sequence, the multivalent NANOBODY® ($V_{HH}$ sequence), the multivalent polypeptide, and/or the multivalent compound or construct is trivalent.

Aspect V-10: Method or use according to any of aspects V-1 to V-6 and/or V-9, wherein the multivalent amino acid sequence, the multivalent NANOBODY® ($V_{HH}$ sequence), the multivalent polypeptide, and/or the multivalent compound or construct is triparatopic.

Aspect V-11: Method or use according to any of aspects V-1 to V-10, wherein said multivalent amino acid sequence, multivalent NANOBODY® ($V_{HH}$ sequence), multivalent polypeptide, multivalent compound or construct and/or pharmaceutical composition comprising the same is administered according to any of the methods of claims U-1 to U-5 and/or U-11 to U-12.

Aspect V-12: Method for the prevention and/or treatment of infection by RSV virus, said method comprising administering, to a subject in need thereof, a pharmaceutically active amount of a multivalent compound or construct according to any of aspects L-9 to L-262 and/or of a pharmaceutical composition comprising the same.

Aspect V-13: Method according to aspect V-12 wherein the multivalent compound or construct is selected from Table A-2 (SEQ ID NO's: 2382 to 2415 and 3584 to 3587) Table A-5 (SEQ ID NO's: 2641 to 2659 and 2978 to 2988), Table A-9 (SEQ ID NO's: 2996 to 2998) or Table A-10 (SEQ ID NO's: 3016 to 3056 and 3588 to 3591).

Aspect V-14: Method according to any of aspects V-12 or V-13, wherein infection by one or more RSV escape mutants is treated.

Aspect V-15: Method according to aspect V-14, wherein the escape mutant is an escape mutant specific for antigenic site II.

Aspect V-16: Method according to aspect V-14, wherein the escape mutant is an escape mutant specific for antigenic site IV-VI.

Aspect V-17: Method according to aspect V-14, wherein the escape mutant is an escape mutant specific for antigenic site II and for antigenic site IV-VI.

Aspect V-18: Use of a multivalent compound or construct according to any of aspects L-9 to L-262, and/or of a pharmaceutical composition comprising the same for binding and/or neutralization one or more different escape mutants of RSV.

Aspect V-19: Use according to claim V-18 wherein the escape mutant is an escape mutant specific for antigenic site II.

Aspect V-20: Use according to claim V-18 wherein the escape mutant is an escape mutant specific for antigenic site IV-VI.

Aspect V-21: Use according to claim V-18 wherein the escape mutant is an escape mutant specific for antigenic site II and antigenic site IV-VI.

Aspect V-22: Method according to any of aspects V-12 or V-13, wherein infection by one or more strains of RSV is treated.

Aspect V-23: Method according to aspect V-22, wherein the RSV strain is Long.

Aspect V-24: Method according to aspect V-22, wherein the RSV strain is A-2.

Aspect V-25: Method according to aspect V-22, wherein the RSV strain is B-1.

Aspect V-26: Method according to any of aspects V-12 to V-13, wherein the multivalent compound or constructs binds and/or neutralizes RSV strain Long and A-2.

Aspect V-27: Method according to any of aspects V-12 to V-13, wherein the multivalent compound or constructs binds and/or neutralizes RSV strain Long and B-1.

Aspect V-28: Method according to any of aspects V-12 to V-13, wherein the multivalent compound or constructs binds and/or neutralizes RSV strain B-1 and A-2.

Aspect V-29: Method according to any of aspects V-12 to V-13, wherein the multivalent compound or constructs binds and/or neutralizes RSV strain Long, A-2 and B-1.

Aspect V-30: Use of a multivalent compound or construct according to any of aspects L-9 to L-262, and/or of a pharmaceutical composition comprising the same for binding and/or neutralization different strains of RSV.

Aspect V-31: Use according to aspect V-30, wherein the strains of RSV are Long and A-2.

Aspect V-32: Use according to aspect V-30, wherein the strains of RSV are Long and B-1.

Aspect V-33: Use according to aspect V-30, wherein the strains of RSV are A-1 and B-1.

Aspect V-34: Use according to aspect V-30, wherein the strains of RSV are Long, A-2 and B-1.

Aspect V-35: Method for the prevention and/or treatment of infection by influenza, said method comprising administering, to a subject in need thereof, a pharmaceutically active amount of a NANOBODY® ($V_{HH}$ sequence) according to any of claims H-1 to H-137, or a multivalent compound or construct according to any of aspects L-9 to L-262, and/or of a pharmaceutical composition comprising the same.

Aspect V-36: Method according to aspect V-35, wherein the multivalent compound or construct is selected from Table A-4 (SEQ ID NO's: 2423 to 2426 and 2428 to 2430).

Aspect V-37: Method according to any of aspects V-35 or V-36, wherein said NANOBODY® ($V_{HH}$ sequence) is 202-C8 (SEQ ID NO: 138).

Aspect V-38: Method according to any of aspects V-35 or V-36, wherein said compound or construct is bivalent.

Aspect V-39: Method according to aspect V-38, wherein said compound or construct is a bivalent 202-C8 NANOBODY® ($V_{HH}$ sequence).

Aspect V-40: Method according to aspect V-39, wherein said compound or construct is selected from SEQ ID NO's: 2423 and 2424.

Aspect V-41: Method according to any of aspects V-35 or V-36, wherein said compound or construct is trivalent.

Aspect V-42: Method according to aspect V-41, wherein said compound or construct is a trivalent 202-C8 NANOBODY® ($V_{HH}$ sequence).

Aspect V-43: Method according to aspect V-42, wherein said compound or construct is selected from SEQ ID NO's: 2425 and 2426.

Aspect V-44: Method according to any of aspects V-35 or V-36, wherein said compound or construct is biparatopic.

Aspect V-45: Method according to any of aspects V-35 or V-36, wherein said compound or construct is trivalent biparatopic.

Aspect V-46: Method according to any of aspects V-35 or V-36, wherein said compound or construct is triparatopic.

Aspect V-47: Method according to any of aspects V-35 or V-36, wherein said compound or construct is trivalent triparatopic.

Aspect V-48: Method according to any of aspects V-35 or V-36, wherein infection by one or more influenza subtypes is treated.

Aspect V-49: Method according to aspect V-48, wherein the influenza subtype is H5N1.

Aspect V-50: Method according to aspect V-48, wherein the influenza subtype is H1N1.

Aspect V-51: Method according to aspect V-50, wherein the influenza subtype causes swine flu (also referred to as Mexican flu).

Aspect V-52: Method according to aspect V-48, wherein the influenza subtype is H3N2.

Aspect V-53: Method according to any of aspects V-35 to V-52, wherein the multivalent compound or constructs binds and/or neutralizes H5N1 and H1N1.

Aspect V-54: Method according to any of aspects V-35 to V-52, wherein the multivalent compound or constructs binds and/or neutralizes H5N1 and H3N2.

Aspect V-55: Method according to any of aspects V-35 to V-52, wherein the multivalent compound or constructs binds and/or neutralizes H1N1 and H3N2.

Aspect V-56: Method according to any of aspects V-35 to V-52, wherein the multivalent compound or constructs binds and/or neutralizes H5N1, H1N1 and H3N2.

Aspect V-57: Use of a multivalent compound or constructs according to any of aspects L-9 to L-262 for binding and/or neutralizing different subtypes of influenza virus.

Aspect V-58: Use of a multivalent compound or constructs according to any of aspects L-9 to L-262 for binding and/or neutralizing influenza subtype H5N1 as well as influenza subtype H1N1.

Aspect V-59: Use of a multivalent compound or constructs according to any of aspects L-9 to L-262 for binding and/or neutralizing influenza subtype H5N1 as well as influenza subtype H3N2.

Aspect V-60: Use of a multivalent compound or constructs according to any of aspects L-9 to L-262 for binding and/or neutralizing influenza subtype H3N2 as well as influenza subtype H1N1.

Aspect V-61: Use of a multivalent compound or constructs according to any of aspects L-9 to L-262 for binding and/or neutralizing influenza subtype H5N1, influenza subtype H3N2 as well as influenza subtype H1N1.

Aspect V-62: Method for the prevention and/or treatment of infection by rabies, said method comprising administering, to a subject in need thereof, a pharmaceutically active amount of a multivalent compound or construct according to any of aspects L-9 to L-262, and/or of a pharmaceutical composition comprising the same.

Aspect V-63: Method according to aspect V-62, wherein the multivalent compound or construct is selected from Table A-6 (SEQ ID NO's: 2427 and 2663 to 2681).

Aspect V-64: Method according to any of aspects V-62 or V-63, wherein infection by one or more rabies genotypes is treated.

Aspect V-65: Method according to aspect V-64, wherein rabies genotype 1 is treated.

Aspect V-66: Method according to aspect V-64, wherein rabies genotype 5 is treated.

Aspect V-67: Method according to any of aspects V-62 to V-66, wherein the multivalent compound or constructs binds and/or neutralizes rabies genotypes 1 and 5.

Aspect V-68: Use of a multivalent compound or constructs according to any of aspects L-9 to L-262 for binding and/or neutralizing different genotypes of rabies virus.

Aspect V-69: Use according to claim V-68, wherein the rabies virus genotypes are 1 and 5.

Aspect W-1: Compound or construct that comprises an Fc portion of an immunoglobulin and one or more NANOBODIES® ($V_{HH}$ sequences) coupled at each side of the Fc portion.

Aspect W-2: Compound or construct according to aspect W-1, wherein one NANOBODY® ($V_{HH}$ sequence) is coupled at each side of the Fc portion.

Aspect W-3: Compound or construct according to aspect W-1, wherein two NANOBODIES® ($V_{HH}$ sequences) are coupled at each side of the Fc portion.

Aspect W-4: Compound or construct according to aspect W-1, wherein one NANOBODY® ($V_{HH}$ sequence) is coupled at one side of the Fc portion and two NANOBODIES® ($V_{HH}$ sequences) are coupled at the other side of the Fc portion.

Aspect W-5: Compound or construct according to any of aspects W-1 to W-4, wherein the Fc portion is derived from an immunoglobulin selected from IgG1, IgG2, IgGA, IgM and IgE.

Aspect W-6: Compound or construct according to any of aspects W-1 to W-5, wherein the NANOBODIES® ($V_{HH}$ sequences) are coupled to the Fc portion via a suitable linker.

Aspect W-7: Compound or construct according to aspect W-6, wherein the linker is a hinge linker.

Aspect W-8: Compound or construct according to any of aspects W-1 to W-7, which has a structure as depicted in FIG. 59.

Aspect W-9: Polypeptide chain construct comprising two polypeptide chains (1) and (2), which each comprise two constant domains (3) and (4), a "first" NANOBODY® ($V_{HH}$ sequence) (5) and a "second" NANOBODY® ($V_{HH}$ sequence) (6), wherein the first NANOBODY® ($V_{HH}$ sequence) (5) is linked, optionally via a suitable linker or hinge region (7) to the constant domain (3) and wherein the second NANOBODY® ($V_{HH}$ sequence) (6) is linked, optionally via a suitable linker or hinge region (8) to the constant domain (4).

Aspect W-10: Construct according to any of aspects W-8 or W-9, wherein the NANOBODIES® ($V_{HH}$ sequences) in each polypeptide chain are directed against the same target, antigen, antigenic determinant or epitope.

Aspect W-11: Construct according to any of aspects W-8 or W-9, wherein the NANOBODIES® ($V_{HH}$ sequences) in each polypeptide chain are directed against a different target, antigen, antigenic determinant or epitope.

Aspect W-12: Compound or construct according to any of aspects W-1 to W-7, which has a structure as depicted in FIG. 62.

Aspect W-13: Polypeptide chain construct comprising two polypeptide chains (1) and (2), which each comprise two constant domains (3) and (4), a "first" NANOBODY® ($V_{HH}$ sequence) (5), a "second" NANOBODY® ($V_{HH}$ sequence) (6), a "third" NANOBODY® ($V_{HH}$ sequence) (10) and a "fourth" single NANOBODY® ($V_{HH}$ sequence) (13), wherein the first NANOBODY® ($V_{HH}$ sequence) (5) is linked, optionally via a suitable linker (7), to the second NANOBODY® ($V_{HH}$ sequence) (6), and is also linked to the constant domain (3), optionally (and usually) via a suitable linker or hinge region (8); and wherein the third NANOBODY® ($V_{HH}$ sequence) (10) is linked, optionally via a suitable linker (12), to the fourth NANOBODY® ($V_{HH}$ sequence) (13), and is also linked to the constant domain (4), optionally (and usually) via a suitable linker or hinge region (14).

Aspect W-14: Construct according to any of aspects W-12 or W-13, wherein the NANOBODIES® ($V_{HH}$ sequences) in each polypeptide chain are directed against the same target, antigen, antigenic determinant or epitope.

Aspect W-15: Construct according to any of aspects W-12 or W-13, wherein the NANOBODIES® ($V_{HH}$ sequences) at one side of each polypeptide chain are directed against the same target, antigen, antigenic determinant or epitope and the NANOBODIES® ($V_{HH}$ sequences) at the other side of each polypeptide chain are directed against another target, antigen, antigenic determinant or epitope.

Aspect W-16: Construct according to any of aspects W-12 or W-13, wherein the NANOBODIES® ($V_{HH}$ sequences) at one side of each polypeptide chain are directed against two different targets, antigens, antigenic determinants or epitopes and the NANOBODIES® ($V_{HH}$ sequences) at the other side of each polypeptide chain are directed against the same two different targets, antigens, antigenic determinants or epitopes.

Aspect W-17: Compound or construct according to any of aspects W-1 to W-7, which has a structure as depicted in FIG. 63.

Aspect W-18: Polypeptide chain construct comprising two polypeptide chains (1) and (2), which each comprise two constant domains (3) and (4), a "first" NANOBODY® ($V_{HH}$ sequence) (5), a "second" NANOBODY® ($V_{HH}$ sequence) (6) and a "third" NANOBODY® ($V_{HH}$ sequence) (10), wherein the first NANOBODY® ($V_{HH}$ sequence) (5) is linked, optionally via a suitable linker (7), to the second NANOBODY® ($V_{HH}$ sequence) (6), and is also linked to the constant domain (3), optionally (and usually) via a suitable linker or hinge region (8); and wherein the third NANOBODY® ($V_{HH}$ sequence) (10) is linked to the constant domain (4), optionally (and usually) via a suitable linker or hinge region (14).

Aspect W-19: Construct according to any of aspects W-17 or W-18, wherein the NANOBODIES® ($V_{HH}$ sequences) in each polypeptide chain are directed against the same target, antigen, antigenic determinant or epitope.

Aspect W-20: Construct according to any of aspects W-17 or W-18, wherein the NANOBODIES® ($V_{HH}$ sequences) at one side of each polypeptide chain are directed against the same target, antigen, antigenic determinant or epitope and the NANOBODY® ($V_{HH}$ sequence) at the other side of each polypeptide chain is directed against another target, antigen, antigenic determinant or epitope.

Aspect W-21: Construct according to any of aspects W-17 or W-18, wherein the NANOBODIES® ($V_{HH}$ sequences) at one side of each polypeptide chain are directed against two different targets, antigens, antigenic determinants or epitopes and the NANOBODY® ($V_{HH}$ sequence) at the other side of each polypeptide chain is directed against another different target, antigen, antigenic determinant or epitope.

Aspect W-22: Construct according to any of aspects W-17 or W-18, wherein the NANOBODIES® ($V_{HH}$ sequences) at one side of each polypeptide chain are directed against two different targets, antigens, antigenic determinants or epitopes and the NANOBODY® ($V_{HH}$ sequence) at the other side of each polypeptide chain is directed against one of these two targets, antigens, antigenic determinants or epitopes.

BRIEF DESCRIPTION OF THE DRAWINGS

Family 1 comprises the following NANOBODIES® ($V_{HH}$ sequences): 192-C10, 206-11H, 206-12F Family 2 comprises the following NANOBODIES® ($V_{HH}$ sequences): 192-A8, 206-10F, 206-11D, 206-7E, 207-9G Family 3 comprises the following NANOBODIES® ($V_{HH}$ sequences): 192-C4, 206-6A, 206-5A, 206-3A, 206-3D, 206-4G, 192-F2, 206-4D, 192-C6, 192-H2, 206-5E, 206-2A, 207-5D, 206-3E, 206-2G, 206-2H, 206-3C, 191-D3, 206-2F, 207-6B, 206-3F, 207-1D Family 4 comprises the following NANOBODIES® ($V_{HH}$ sequences): 191-B9, 207-9A, 207-9B, 207-9H, 206-10C, 206-10D, 192-D3, 206-10B, 207-9D, 207-11D, 207-11E, 206-10E, 191-E4, 207-1C, 207-1F, 207-5C, 207-1E, 207-4D, 206-2E, 206-7H, 207-11F, 207-9F, 207-11H, 192-B1, 206-3B, 207-11B, 207-4H, 192-H1, 206-6D, 206-7B, 207-11A, 207-11A, 207-5B, 207-4A, 207-4B, 207-6A, 207-6D, 207-1B, 207-5A, 207-6C, 207-5E, 207-6E, 207-6F, 207-11G
Family 5 comprises the following NANOBODIES® ($V_{HH}$ sequences): 207-9C
Family 6 comprises the following NANOBODIES® ($V_{HH}$ sequences): 206-7G
Family 7 comprises the following NANOBODIES® ($V_{HH}$ sequences): 207-9E
Family 8 comprises the following NANOBODIES® ($V_{HH}$ sequences): 206-2C
Family 9 comprises the following NANOBODIES® ($V_{HH}$ sequences): 206-7C

FIG. 42: Bioavailability in plasma of pulmonary administered vs i.v. administered NANOBODIES® ($V_{HH}$ sequences).

FIG. 65: Schematic overview of the humanized residues introduced in selected NC41 variants. Dots indicate the presence of the wildtype residue; letters correspond to the humanized residue. Numbering is according to Kabat.

FIG. 67: Neutralization of hRSV Long strain and B-1 strain by monovalent and trivalent humanized NC41 variants.

EXAMPLES

Example 1

Immunizations

Figure 1:
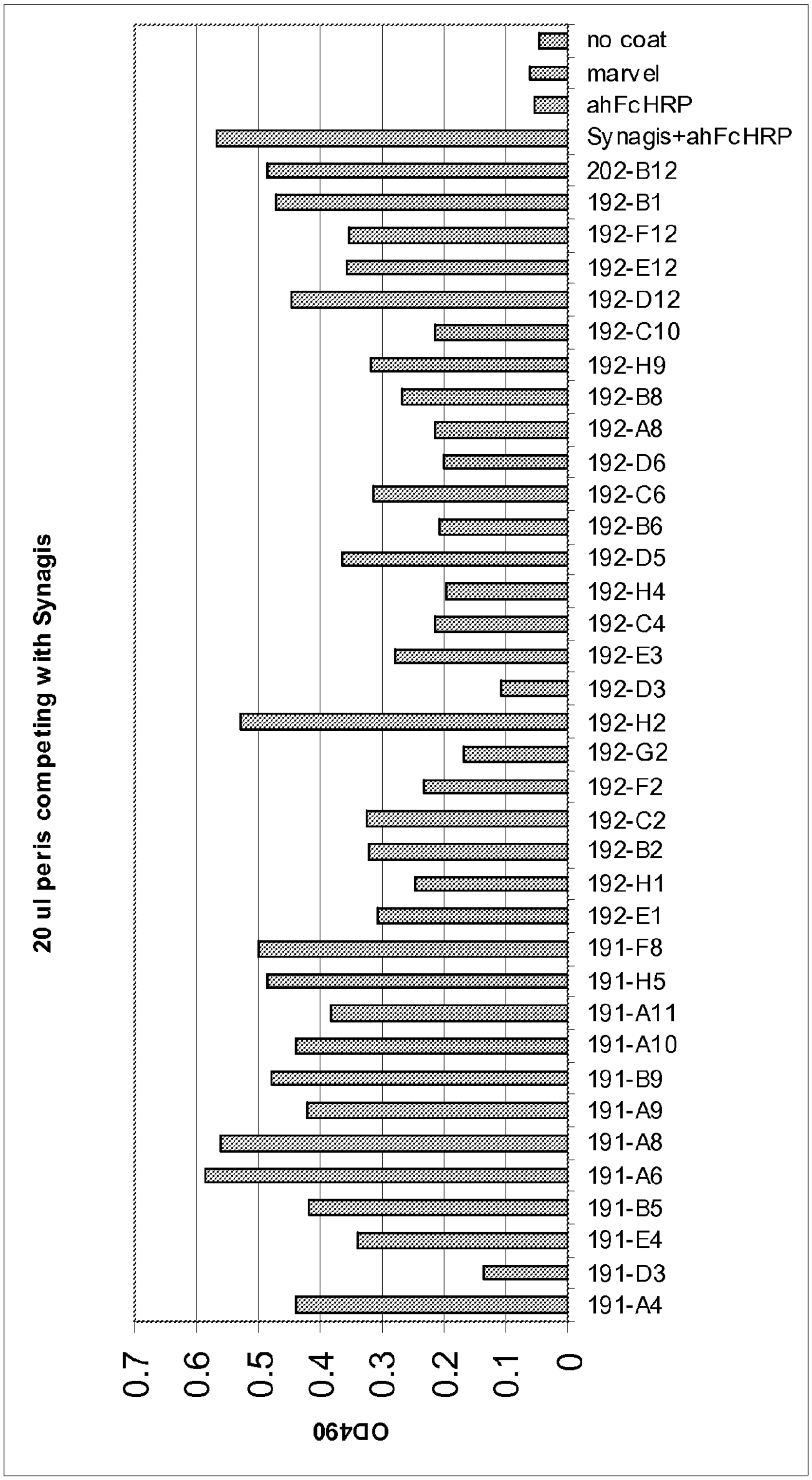
FIG. 1: Competition of NANOBODIES® ($V_{HH}$ sequences) of the invention with Synagis® for binding to the F-protein of hRSV. 20 µl periplasmic fractions binding hRSV $F_{TM-}$ were incubated with 100 ng/ml Synagis®, as described in Example 7. Binding specificity was determined based on OD values compared to controls having received no NANOBODY® ($V_{HH}$ sequence) (Synagis®+ahFcHRP).

Two llamas (156 and 157) were immunized according to standard protocols with 6 boosts of hRSV $F_{TM-}$ (membrane anchorless form of the fusion protein, 70 kDa; Conan T. et al. 2007, BMC Biotechnol. 7: 17). Blood was collected from these animals 7 days after boost 6 and 10 days after boost 6.

Two llamas (140 and 163) were immunized according to standard protocols with 6 boosts of H5 Hemagglutinin (HA, A/Vietnam/1203/2004 (H5), Protein Sciences Cat. No. 3006). Blood was collected from these animals 10 days after boost 6.

Two llamas (183 and 196) were immunized according to standard protocols with 6 boosts of Rabies vaccine (inactivated rabies virus; Sanofi Pasteur MSD). Blood was collected from these animals 7 days after boost 6, 17 days after boost 6 and 21 days after boost 6.

Example 2

Library Construction

Peripheral blood mononuclear cells were prepared from blood samples using Ficoll-Hypaque according to the manufacturer's instructions. Next, total RNA was extracted from these cells as well as from the lymph node bow cells and used as starting material for RT-PCR to amplify NANOBODY® ($V_{HH}$ sequence) encoding gene fragments. These fragments were cloned into phagemid vector derived from pUC119 which contains the LacZ promoter, a coliphage pIII protein coding sequence, a resistance gene for ampicillin or carbenicillin, a multicloning site and the gen3 leader sequence. In frame with the NANOBODY® ($V_{HH}$ sequence) coding sequence, the vector codes for a C-terminal c-myc tag and a (His)6 tag. Phage was prepared according to standard methods and stored at 4° C. for further use, making phage libraries 156, 157, 140b, 163b, 183 and 196b.

Example 3

Selections Against hRSV hRSV is a member of the Paramyxoviridae family and is an enveloped virus with two main surface glycoproteins that make the spikes of the virus particle. One of these glycoproteins (protein G) is the attachment protein that mediates binding of the virus to the cell surface. The other glycoprotein (protein F or fusion) mediates fusion of the viral and cell membranes, allowing the entry of the viral nucleocapsid into the cell cytoplasm Inhibition of the steps mediated by either G or F glycoproteins blocks the initial stages of the infectious cycle and neutralizes virus infectivity. Therefore, antibodies directed against either G or F, and which inhibit their respective activities, neutralize virus infectivity and may protect against a hRSV infection. The F protein is highly conserved and forms trimeric spikes that undergo conformational changes upon activation.

Human respiratory syncytial virus (hRSV) is the leading cause of severe lower respiratory tract infections (bronchiolitis and pneumonia) in infants and very young children and causes annual epidemics during the winter months. The virus also causes a substantial disease burden among the elderly and adults with underlying cardiopulmonary disorders and/or immunosuppressive conditions are also at risk of severe hRSV disease. The immune response does not prevent reinfections.

There is no vaccine available to prevent hRSV infections. The only drug product available in the market is a humanized monoclonal antibody (Synagis®) directed against one of the viral glycoproteins (protein F) which is used prophylactically in children that are at a very high risk of suffering a severe hRSV infection. The restricted use of Synagis® is due, at least in part, to the high cost of this product.

To identify NANOBODIES® ($V_{HH}$ sequences) recognizing the $F_{TM}$- (membrane anchorless form of the fusion protein, 70 kDa, Corrall T. et al. 2007, BMC Biotechnol. 7: 17), libraries 156 and 157 were used. The same antigen was used for selections as for immunizations. The $F_{TM}$- protein (25 ng/well) was immobilized on Nunc Maxisorp ELISA plates. A control was included with 0 μg/ml $F_{TM}$-. Bound phages were eluted from the $F_{TM}$-using trypsin and Synagis® (Palivizumab, MedImmune, humanized monoclonal antibody, described in Zhao & Sullender 2005, J. Virol. 79: 3962) in the first and second round of selections. Remicade (Infliximab, anti-TNF; Centorcor) was used as a control for Synagis®. A 100 molar excess of Synagis® was used in order to identify NANOBODIES® ($V_{HH}$ sequences) binding specifically at the binding site on RSV. Outputs from the first round selections, eluted with Synagis® were used for second round selections.

Outputs of both rounds of selections were analyzed for enrichment factor (phage present in eluate relative to controls). Based on these parameters the best selections were chosen for further analysis. Individual colonies were picked and grown in 96 deep well plates (1 ml volume) and induced by adding IPTG for NANOBODY® ($V_{HH}$ sequence) expression. Periplasmic extracts (volume: ~80 μl) were prepared according to standard methods.

Example 4

Selections Against H5N1

Influenza is an enveloped virus with two main surface antigens, the hemagglutinin (HA) and the neuraminidase (NA). The influenza HA is responsible for virus attachment to target host cells via recognition and binding to sialic acid receptors on membrane-bound proteins of the host cell.

By analysis using monoclonal antibody-resistant mutants it has been shown that neutralizing antibody binding sites map to regions on the surface of the globular membrane distal domains of the HA. Bi- or multispecific NANOBODIES® ($V_{HH}$ sequences) can exhibit enhanced neutralizing potency and can reduce the incidence of escape mutants in comparison to monospecific NANOBODIES® ($V_{HH}$ sequences), or currently used monoclonals.

Human infections with avian influenza H5N1 virus were first observed during large scale poultry outbreaks in Hong Kong in 1997. Since its re-emergence in Asia in 2003, 277 laboratory-confirmed human H5N1 cases have been reported from Asia, Europe and Africa of whom 167 have died (WHO, $1^{st}$ March 2007). In general, humans who catch a humanized Influenza A virus (a human flu virus of type A) usually have symptoms that include fever, cough, sore throat, muscle aches, conjunctivitis and, in severe cases, breathing problems, pneumonia, fever, chills, vomiting and headache. Tissue damage associated with pathogenic flu virus infection can ultimately result in death. The inflammatory cascade triggered by H5N1 has been called a 'cytokine storm' by some, because of what seems to be a positive feedback process of damage to the body resulting from immune system stimulation. H5N1 induces higher levels of cytokines than the more common flu virus types. The mortality rate of highly pathogenic H5N1 avian influenza in a human is high; WHO data indicates that 60% of cases classified as H5N1 resulted in death. Influenza virus entry inhibitors may have potential uses as antivirals, prophylactics and as topical treatments (i.e. nasal sprays). These inhibitors may also serve as useful tools in H5N1 vaccine and antiviral research by elucidating novel epitopes involved in protective immune responses against the virus.

To identify NANOBODIES® ($V_{HH}$ sequences) recognizing the hemagglutinin (HA) of Influenza H5N1, libraries 140b and 163b were used. The same antigen was used for selections as for immunizations. The H5N1 recombinant HA (A/Vietnam/1203/2004 (H5N1), Protein Sciences Cat. No. 3006) was immobilized on Nunc Maxisorp ELISA plates. A control was included with 0 μg/ml HA. Bound phages were eluted from the HA using trypsin in the first and trypsin and VN04-2 (Mouse Monoclonal Anti-H5 Hemagglutinin of A/Vietnam/1203/04 Influenza Virus, Rocklnad Inc. Cat. No. 200-301-975) in the second round of selections. Mouse IgG was used as an antibody control. A 100 molar excess of the antibody was used in order to identify NANOBODIES® ($V_{HH}$ sequences) binding specifically at the binding site on influenza HA. Outputs from the first round selections were used for second round selections.

Outputs of both rounds of selections were analyzed for enrichment factor (phage present in eluate relative to controls). Based on these parameters the best selections were chosen for further analysis. Individual colonies were picked and grown in 96 deep well plates (1 ml volume) and induced by adding IPTG for NANOBODY® ($V_{HH}$ sequence) expression. Periplasmic extracts (volume: ~80 μl) were prepared according to standard methods.

Example 5

Selections Against Rabies

Rabies is a neurotropic virus that belongs to one of the largest families (Rhabdoviridae) of viruses. It is surrounded by an envelope in which glycoprotein G is embedded. Glycoprotein G is responsible for the induction of protective immunity and contains different motifs that define virulence and pathogenicity.

Glycoprotein G consists of 505 amino-acids and a typical rabies virion contains about 1800 of these proteins. Glycoprotein G binds to the cellular receptor, leading to endocytosis of the virus-receptor complex. Glycoprotein G is the immunodominant antigen of the virus and antibodies are typically directed against 1 of 8 antigenic sites on glycoprotein G, some of which are highly conserved between different strains and genotypes. Neutralizing antibodies prevent binding and entry into the target host cell by blocking binding of viral proteins to the target host cell.

Rabies continues to be a serious worldwide health problem. Each year, an estimated 55,000 people die from rabies and 10 million people are treated after contact with suspected animals.

Rabies virus causes encephalitis in man and animal. The virus is excreted in saliva and transmitted by close contact with infected animals through bites, scratches or licks. Once introduced in a wound, it replicates locally in the muscle cells. After an incubation period of a few days up to several years, the virus crawls up in the peripheral nerves and reaches the brain via retrograde axonal transport. This is followed by extensive replication in the cytoplasm of neurons, brain dysfunction and death. Once symptoms of the disease develop, rabies is fatal.

There is no cure for rabies and once the virus reaches the central nervous system, the patient will die. The present treatment is post-exposure with vaccinations with inactivated virus. Two sources of antibodies are available for passive immunization: human rabies immunoglobulins (HRIG: Imogam, Aventis Pasteur) and equine rabies immunoglobulins (ERIG). These are purified from pooled sera of vaccinated people or horses and administered directly after the bite. Due to technical and economical limitations, the supply of rabies immunoglobulins is limited and there is a worldwide shortage. Immunoglobulins can trigger allergic reactions ranging form skin erythema, fever to anaphylactic shock (as described in the patient information leaflet). The possibility of contamination with blood-borne infectious agents can not be excluded. The WHO strongly recommends that more cost-efficient and safer alternatives should be developed.

To identify NANOBODIES® ($V_{HH}$ sequences) recognizing the Rabies G protein, libraries 183 and 196b were used. The Rabies virus (rabies inactivated HDCV vaccine; Sanofi Pasteur MSD) was immobilized on Nunc Maxisorp ELISA plates. A control was included with 0 µg/ml. Precoated 8 well strips (Platelia II Rabies plates, BioRad cat no 355-1180) were also used for selections in both first and second round. Phages were preincubated with 100 mg/ml BSA, because the rabies vaccine contained 50 mg/ml HSA. Bound phages were eluted from the virus using trypsin in the first and second round. Bound phages were eluted from the G protein with trypsin or a mouse monoclonal MAb 8-2m or Ab 8-2, a mouse IgG2a (Montaño-Hirose et al. 1993, Vaccine 11: 1259-1266) in the first and second round of selections. A mouse IgG2a was used as an antibody control. A 100 molar excess of the antibody was used in order to identify NANOBODIES® ($V_{HH}$ sequences) binding specifically at the binding site on rabies virus. Outputs from the first round selections were used for second round selections.

Outputs of both rounds of selections were analyzed for enrichment factor (phage present in eluate relative to controls). Based on these parameters the best selections were chosen for further analysis. Individual colonies were picked and grown in 96 deep well plates (1 ml volume) and induced by adding IPTG for NANOBODY® ($V_{HH}$ sequence) expression. Periplasmic extracts (volume: ~80 µl) were prepared according to standard methods.

Example 6

Screening for Binding

In order to determine binding specificity to the viral envelope proteins, the clones were tested in an ELISA binding assay setup. In short, 2 µg/ml of $F_{TM-}$ or 5 µg/ml H5N1 HA were immobilized directly on Maxisorp microtiter plates (Nunc). Rabies G protein precoated plates from BioRad were used (Cat. No. 355-1180). Free binding sites were blocked using 4% Marvel in PBS. Next, 10 µl of periplasmic extract containing NANOBODY® ($V_{HH}$ sequence) or monoclonal phages of the different clones in 100 µl 2% Marvel PBST were allowed to bind to the immobilized antigen. After incubation and a wash step, NANOBODY® ($V_{HH}$ sequence) binding was revealed using a rabbit-anti-VHH secondary antibody (for the periplasmic fractions) or an anti-M13 antibody against the phages gene3. After a wash step the NANOBODIES® ($V_{HH}$ sequences) in the periplasmic fractions were detected with a HRP-conjugated goat-anti-rabbit antibody. Binding specificity was determined based on OD values compared to controls having received no NANOBODY® ($V_{HH}$ sequence).

(a) hRSV

Phage binding ELISA showed binders for both library 156 (61%) and 157 (59%) after the first round of selections and Synagis® elutions.

Phage binding ELISA showed binders for both library 156 (85%) and 157 (50%) after the first round of selections and trypsin elutions.

Periplasmic fraction binding ELISA showed binders for both library 156 (83%) and 157 (78%) after the second round of selections and trypsin elutions.

Periplasmic fraction binding ELISA showed binders for both library 156 (87%) and 157 (68%) after the second round of selections and Synagis® elutions.

(b) H5N1

Periplasmic fraction binding ELISA showed binders for both library 140b (35%) and 163b (24%) after the second round of selections and monoclonal antibody elutions.

Periplasmic fraction binding ELISA showed binders for both library 140b (37%) and 163b (33%) after the second round of selections and trypsins elutions.

(c) Rabies

Periplasmic fraction binding ELISA showed binders for the rabies virus from both library 183 (67%) and 196 (48%) after the second round of selections on virus and trypsin elutions. No binders for the G protein from the virus selected periplasmic fractions. No binders for HSA control.

Periplasmic fraction binding ELISA showed binders for G protein from both library 183 (50%) and 196 (75%) after the second round of selections and trypsins elutions.

Periplasmic fraction binding ELISA showed binders for G protein from library 196 (37%) after the second round of selections and monoclonal antibody elutions.

Sequences of the obtained NANOBODIES® ($V_{HH}$ sequences) are given in Table A-1.

Clustering of the obtained NANOBODIES® ($V_{HH}$ sequences) is shown in FIGS. 12 to 17.

Example 7

Screening for Competition

Competition assays were set up with the NANOBODIES® ($V_{HH}$ sequences) competing with monoclonal, neutralizing antibodies, Synagis® for hRSV, VN04-2 (as described in Hanson et al. 2006, Respiratory Research 7: 126) for H5N1 and a mouse IgG2a monoclonal (as described in Montaño-Hirose et al. 1993, Vaccine 11: 1259-1266) against Rabies. A chessboard ELISA was run to determine the best coating concentration of antigen and the concentration of antibody that gave $IC_{50}$.

Figure 2:
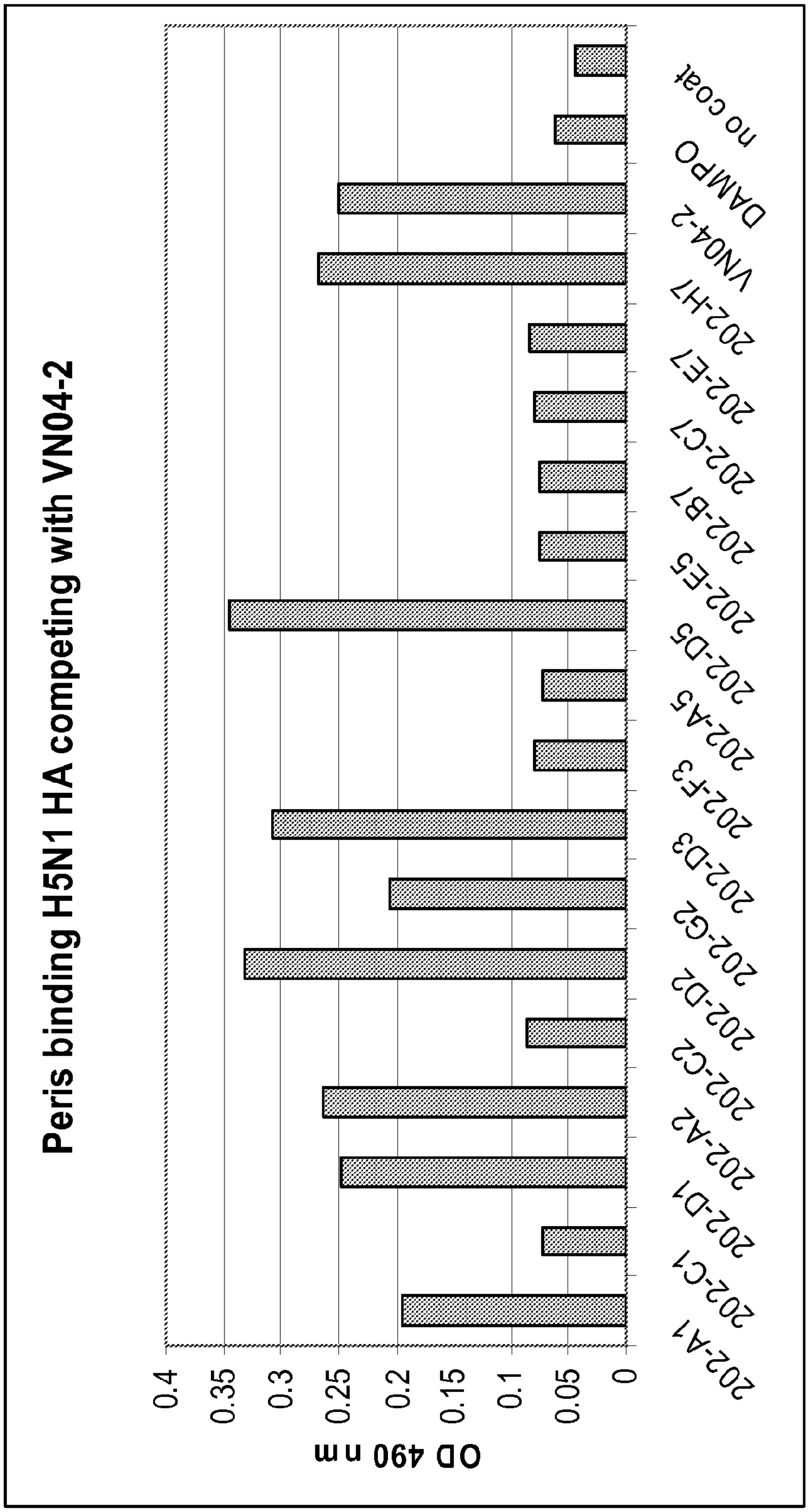
FIG. 2: Competition of NANOBODIES® ($V_{HH}$ sequences) of the invention with VN04-2 for binding to the hemagglutinin of influenza H5N1. 20 µl periplasmic fractions were incubated with 100 ng/ml VN04-2, as described in Example 7. Binding specificity was determined based on OD values compared to controls having received no NANOBODY® ($V_{HH}$ sequence) (VN04-2).
Figure 3:
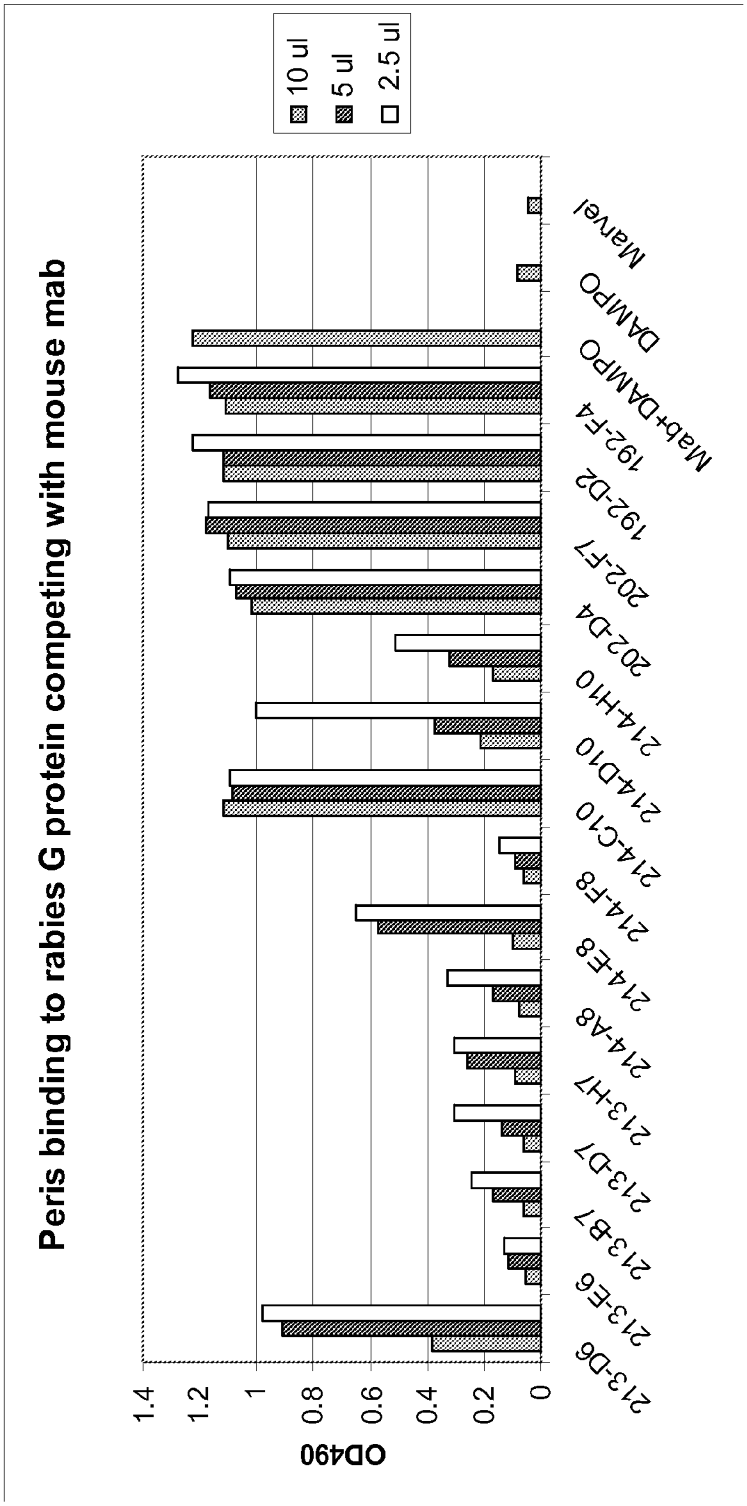
FIG. 3: Competition of NANOBODIES® ($V_{HH}$ sequences) of the invention with IgG2a for binding to the G-protein of rabies. Dilution of periplasmic fractions binding rabies G protein were incubated with mouse IgG2a monoclonal (mab) (dilution $1/10^6$), as described in Example 7. Binding specificity was determined based on OD values compared to controls having received no NANOBODY® ($V_{HH}$ sequence) (Mab+DAMPO).
Figure 4:
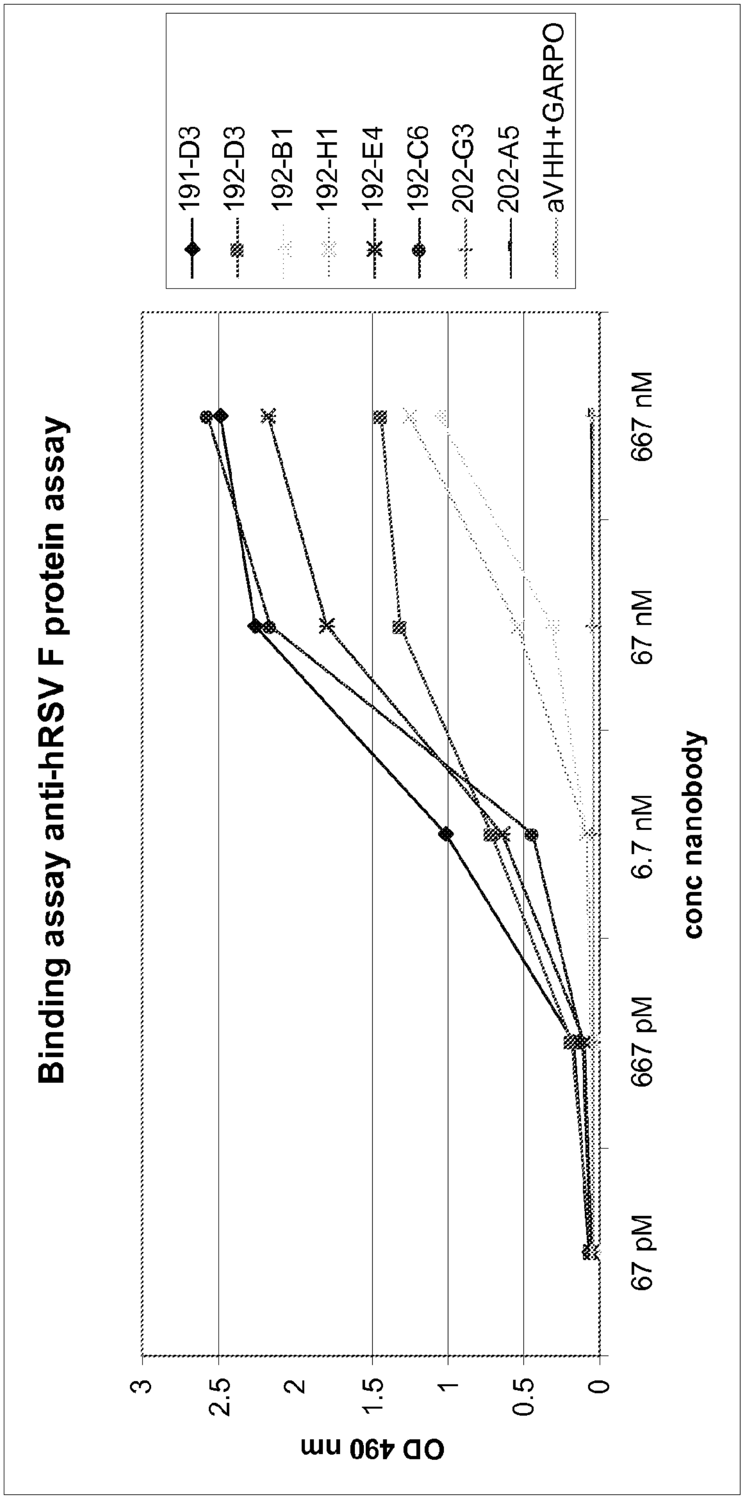
FIG. 4: Binding assay with a dilution series of purified anti-hRSV F protein NANOBODIES® ($V_{HH}$ sequences).
Figure 5:
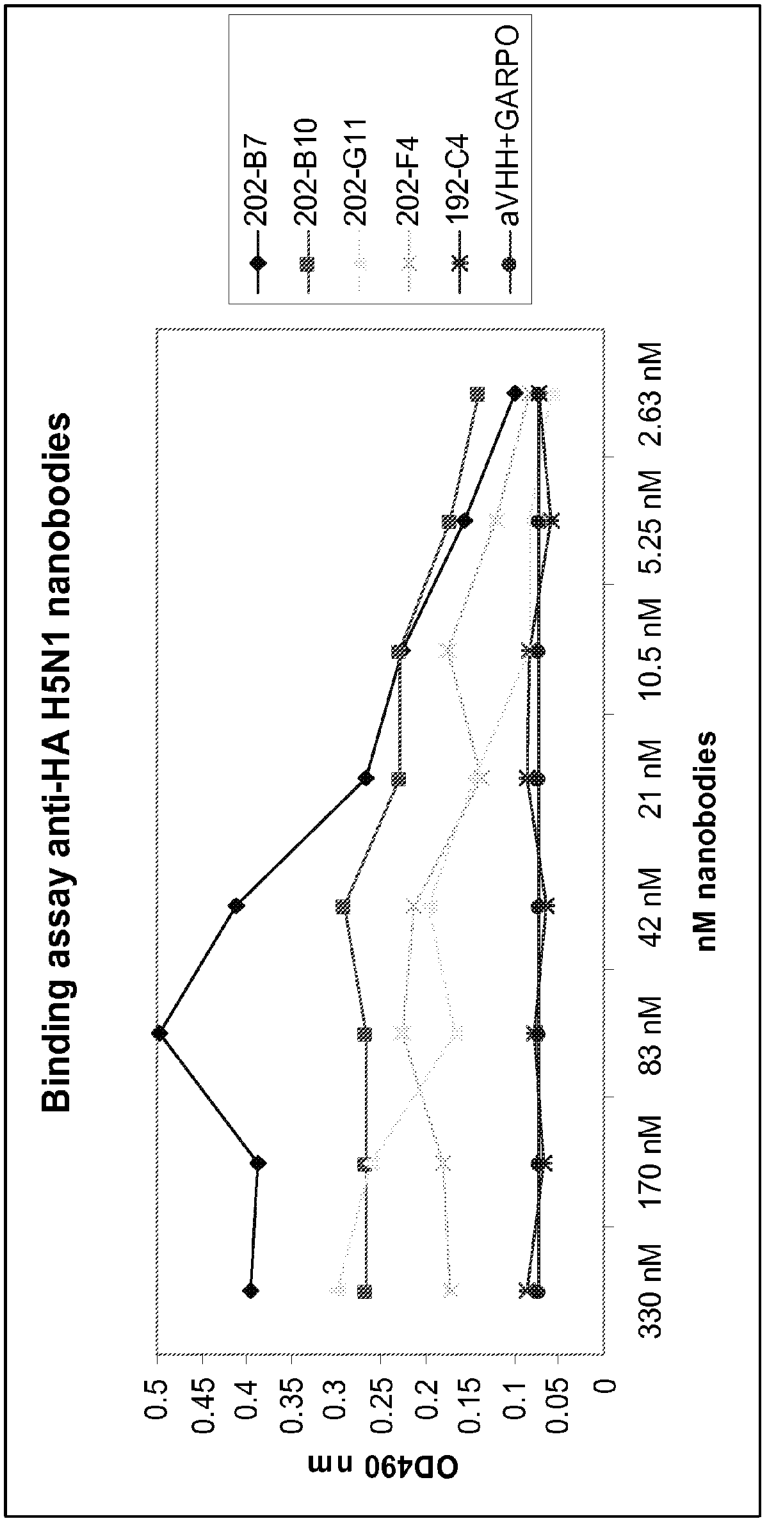
FIG. 5: Binding assay with a dilution series of purified anti-H5 HA Nanobodies.

In short, the antigen was immobilized on Maxisorp microtiter plates (Nunc) and free binding sites were blocked using 4% Marvel in PBS. Next, 100 ng/ml of Synagis®, VN04-2 or mouse IgG2a monoclonal (mab) (dilution 1/$10^6$) was preincubated with 20 μl of periplasmic extract containing NANOBODY® ($V_{HH}$ sequence) of the different clones. Control periplasmic fractions selected against other viral coat proteins were included. The competing antibody was allowed to bind to the immobilized antigen with or without NANOBODY® ($V_{HH}$ sequence). After incubation and a wash step, antibody binding was revealed using a HRP-conjugated goat anti-human Fc antibody (ahFcHRP; Synagis®) or HRP-conjugated donkey anti-mouse antibody (DAMPO; VN04-2 and IgG2a). Binding specificity was determined based on OD values compared to controls having received no NANOBODY® ($V_{HH}$ sequence) (FIGS. 1, 2 and 3). All targets had periplasmic fractions competing with the neutralizing antibodies. From these clones, based on their sequence, clones were recloned in an expression vector derived from pUC119 which contains the LacZ promoter, a resistance gene for ampicillin or carbenicillin, a multicloning site and the gen3 leader sequence. In frame with the NANOBODY® ($V_{HH}$ sequence) coding sequence, the vector codes for a C-terminal c-myc tag and a (His)6 tag. NANOBODIES® ($V_{HH}$ sequences) were produced and purified via the His-tag on Talon beads. Purified NANOBODIES® ($V_{HH}$ sequences) were shown to bind their respective antigen as shown in FIGS. 4 and 5.

Example 8

Determining Competition Efficiency by Titration of Purified NANOBODY® ($V_{HH}$ Sequence)

In order to determine competition efficiency of hRSV $F_{TM^-}$ and H5N1 HA binding NANOBODIES® ($V_{HH}$ sequences), the positive clones of the binding assay were tested in an ELISA competition assay setup.

Figure 6:
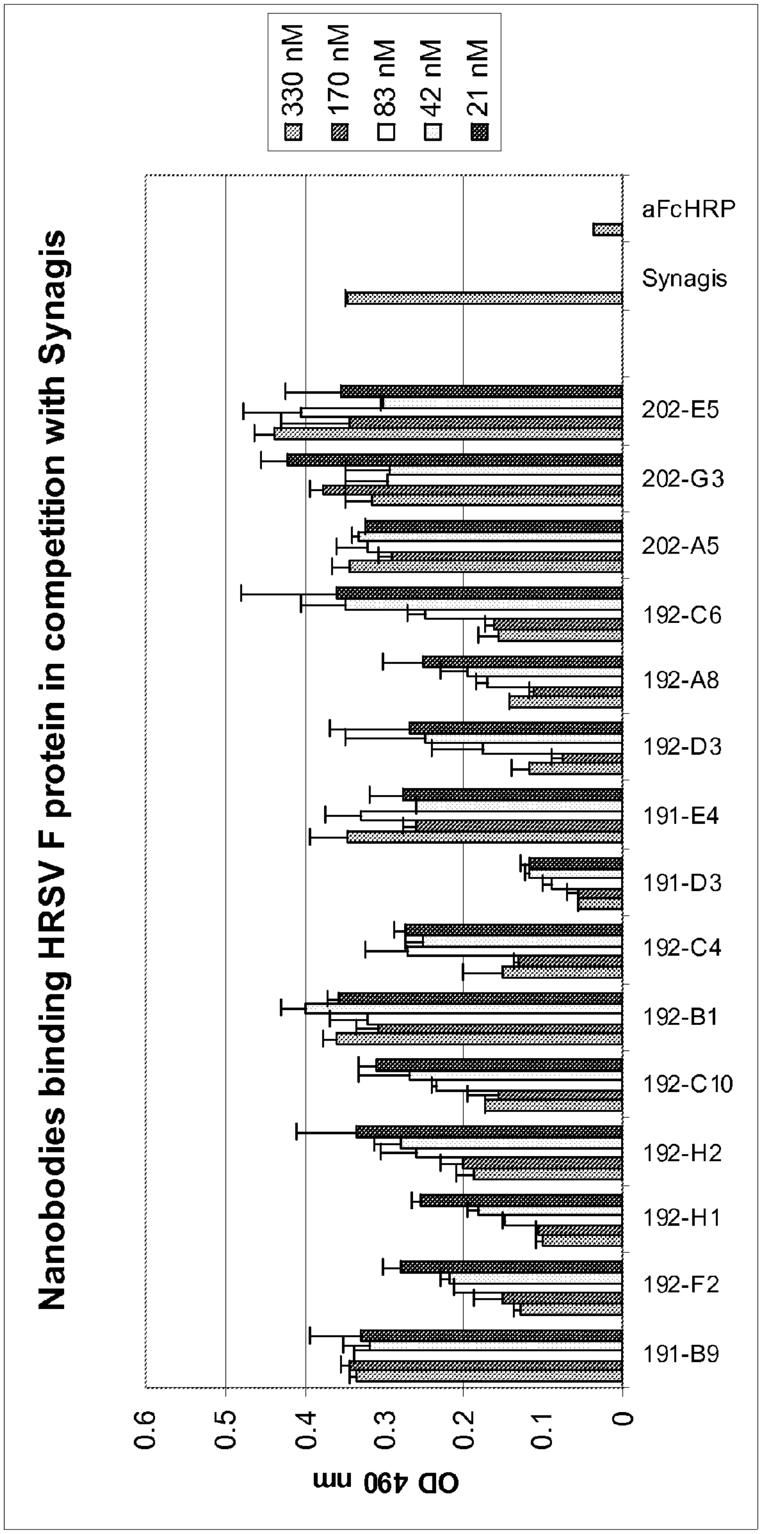
FIG. 6: Competition of purified NANOBODIES® ($V_{HH}$ sequences) of the invention with Synagis® for binding to the F-protein of hRSV. Dilution series of NANOBODIES® ($V_{HH}$ sequences) binding 1.4 nM hRSV $F_{TM-}$ compete with 0.67 nM Synagis®, as described in Example 8. Binding specificity was determined based on OD values compared to controls having received no NANOBODY® ($V_{HH}$ sequence) (Synagis®). Bars indicate Standard Deviation from duplicates.
Figure 7:
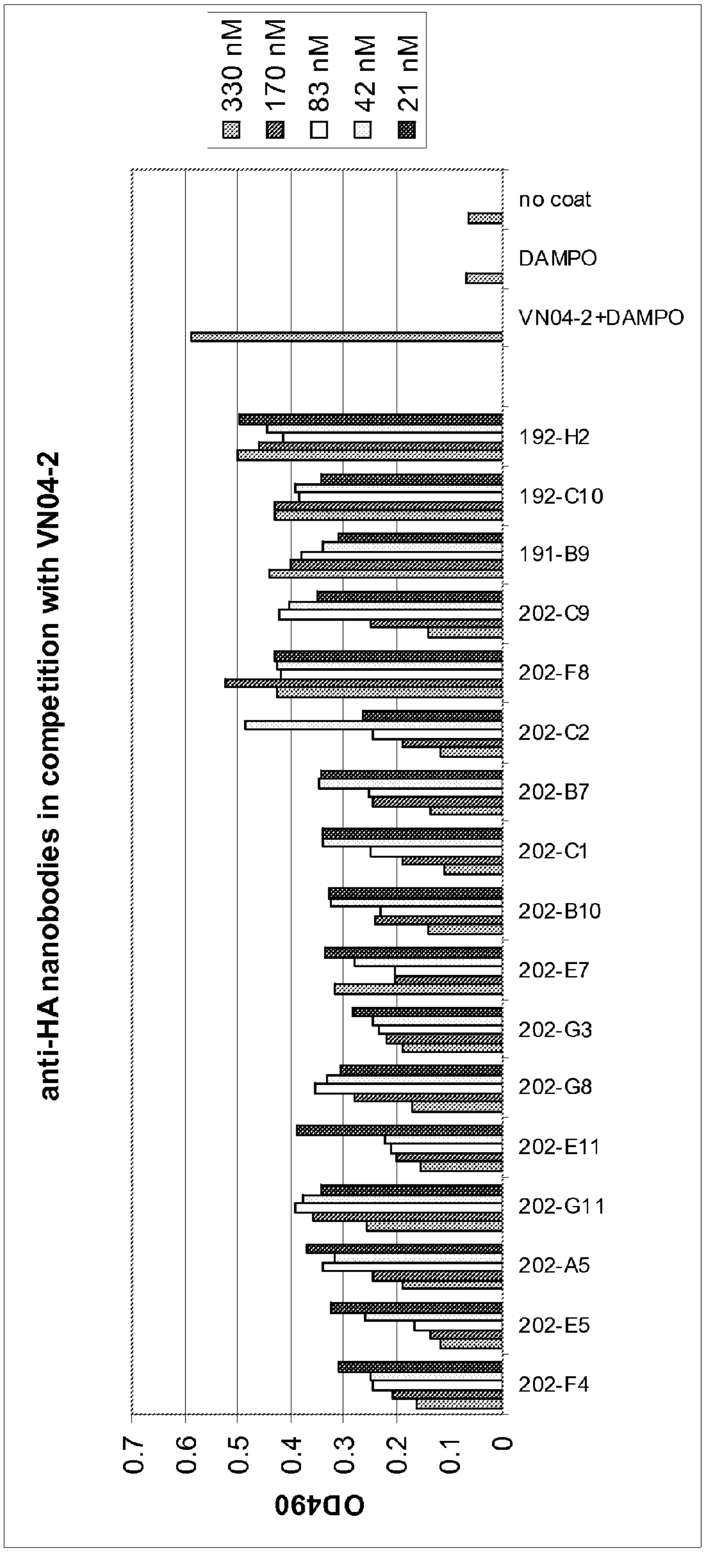
FIG. 7: Competition of purified NANOBODIES® ($V_{HH}$ sequences) of the invention with VN04-2 for binding to the hemagglutinin of influenza H5N1. Dilution series of NANOBODIES® ($V_{HH}$ sequences) binding H5 HA competing with 0.67 nM VN04-2, as described in Example 8. Binding specificity was determined based on OD values compared to controls having received no NANOBODY® ($V_{HH}$ sequence) (VN04-2+DAMPO).

In short, 2 μg/ml $F_{TM^-}$ or 2.5 μg/ml HA was immobilized on Maxisorp microtiter plates (Nunc) and free binding sites were blocked using 4% Marvel in PBS. Next, a dilution series of purified NANOBODIES® ($V_{HH}$ sequences) were allowed to bind to the antigen for 30 minutes before 100 ng/ml (0.67 nM) Synagis® or VN04-2 was incubated. Irrelevant NANOBODIES® ($V_{HH}$ sequences) against other viral coat proteins were used as negative controls (202 against H5N1 for hRSV competition, 191, and 192 against hRSV for H5N1 competitions). The results are shown in FIGS. 6 and 7. NANOBODIES® ($V_{HH}$ sequences) were found for both hRSV and H5N1 competing with monoclonal antibodies.

Example 9

Cell Based and Animal Experiments

To investigate if selected NANOBODIES® ($V_{HH}$ sequences) recognize different epitopes, epitope mapping could be performed by using monoclonal antibodies which recognize known epitopes. Examples of antibodies against hRSV that may be used are:

Synagis® (Palivizumab, MedImmune, humanized monoclonal antibody, as described in Zhao & Sullender 2005, J. Virol. 79: 3962), directed to an epitope in the A antigenic site of the F protein, non-competing with 9C5.

9C5 (HyTest Ltd) (described in Krivitskaia et al. 1999, Vopr. Virusol 44: 279), neutralizing mouse monoclonal, hampers the virus penetration into the cell, recognizes epitope Fla of RSV F-protein, non-competing with Synagis®.

101F (WO 06/050280), humanized mouse monoclonal, directed to an epitope of the RSV F-protein comprising amino acids 423-436 as minimal peptide, non-competing with Synagis® and 9C5.

In vitro neutralization assays of selected NANOBODIES® ($V_{HH}$ sequences) against virus are used to investigate the neutralizing capacity of the NANOBODIES® ($V_{HH}$ sequences). One example is the rabies virus neutralization assay, Rapid Fluorescent Focus Inhibition Test (RFFIT) (Standard procedure from WHO Laboratory Techniques in Rabies, 1996), where a standard quantity of free rabies virus is pre-incubated with different dilutions of NANOBODIES® ($V_{HH}$ sequences). Then the NANOBODY® ($V_{HH}$ sequence)-virus mixture is added on a monolayer of susceptible Baby Hamster Kidney (BHK) cells. Twenty-four hours later, cells are fixed and stained with a green-fluorescent anti-rabies conjugate to quantify infected cells. Absence of fluorescent cells indicates prior neutralization of the virus inoculum. The neutralizing capacity of a NANOBODY® ($V_{HH}$ sequence) preparation is expressed in International Units (IU)/ml in reference to the WHO standard (=anti-rabies IgG purified from sera of vaccinated humans).

To investigate the in vivo neutralizing capacity of rabies infection by the NANOBODIES® ($V_{HH}$ sequences), intracerebral inoculation in mice is used, where both the virus and the NANOBODIES® ($V_{HH}$ sequences) are administered directly in the brain.

Example 10

Bi- and Trivalent NANOBODIES® ($V_{HH}$ Sequences)

Increased avidity and function have been observed for NANOBODIES® ($V_{HH}$ sequences) that are bi- or trivalent with either homo- or heteromers of selected NANOBODIES® ($V_{HH}$ sequences). This is an option to target viral trimeric spikes, either different epitopes or the same epitopes on the spike.

Protocols are available for construction of a trivalent NANOBODY® ($V_{HH}$ sequence) connected by Gly-Ser linkers of any desired length and composition. It is based on the separate PCR reactions (1 for the N-terminal, 1 for the middle (if trivalent) and 1 for the C-terminal VHH subunit) using different sets of primers. Different linker lengths can also be introduced by the primers.

Example 11

Figure 8:
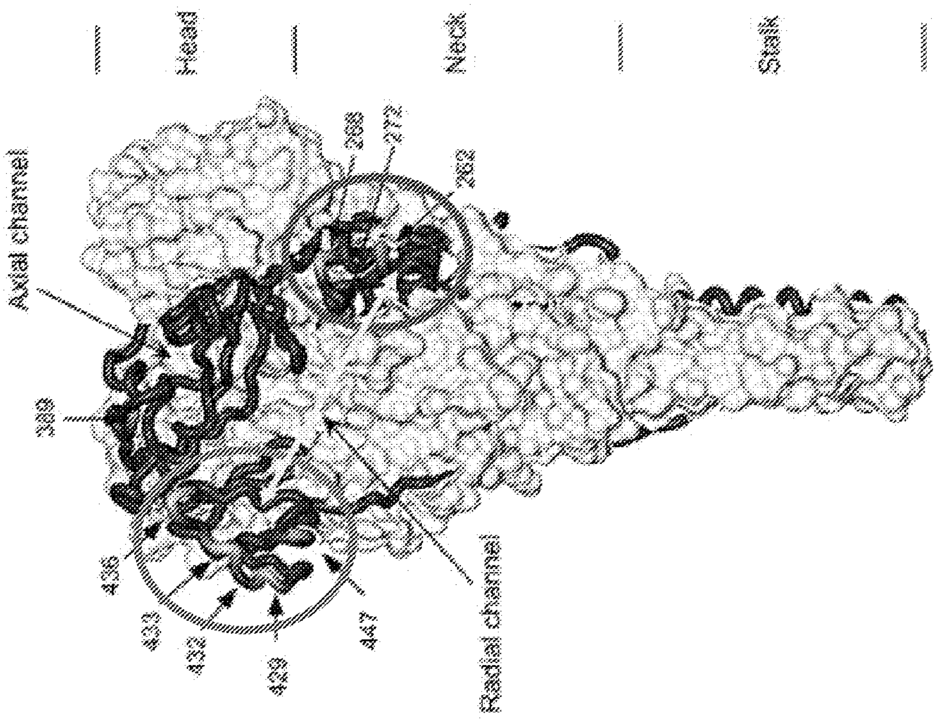
FIG. 8: hRSV $F_{TM-}$ protein with Site II (binding site Synagis®; residues 255-280) and Site IV-VI (binding site 101F; residues 422-438).

Screening for NANOBODIES® ($V_{HH}$ Sequences) Binding Different Epitopes of the Trimeric Spike Proteins For hRSV different monoclonal antibodies are available recognizing different epitopes of the $F_{TM^-}$ protein. In order to screen for NANOBODIES® ($V_{HH}$ sequences) recognizing three different epitopes the following antibodies or Fab fragments were used: mouse monoclonal 9C5 (3ReS21, Hytest), 101F Fab (WO 2006/050280) and Synagis® (Medimmune). They all bind to different epitopes on the $F_{TM^-}$ protein and were used for competition with selected NANOBODIES® ($V_{HH}$ sequences). 9C5 is believed to bind to an epitope around amino acid 389, 101F at amino acids 422-438 and Synagis® at amino acids 255-280 (see FIG. 8).

Figure 9:
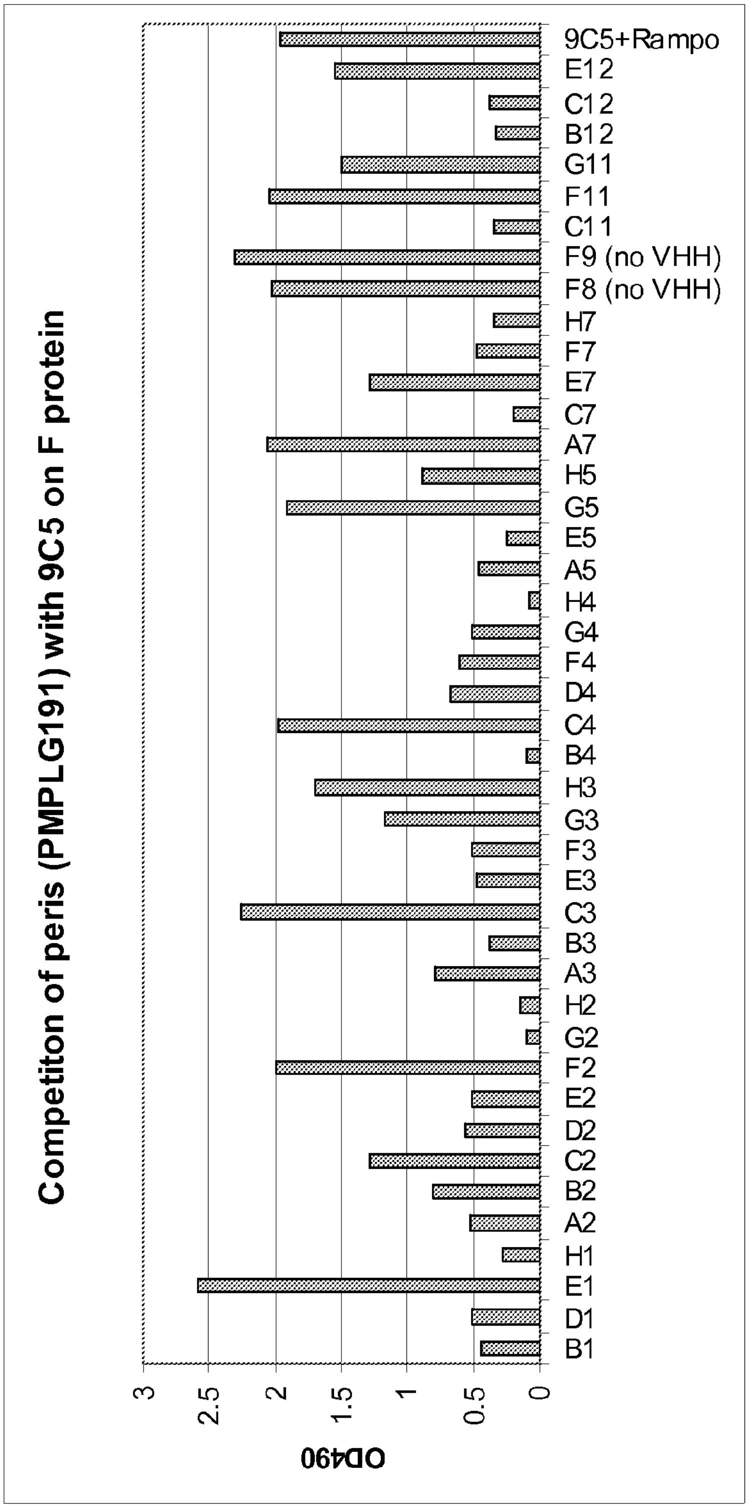
FIG. 9: Competition of NANOBODIES® ($V_{HH}$ sequences) of the invention with 9C5 for binding to the F-protein of hRSV. 20 ul periplasmic fractions binding hRSV $F_{TM-}$ compete with 100 ng/ml 9C5, as described in Example 11. Binding specificity was determined based on OD values compared to controls having received no NANOBODY® ($V_{HH}$ sequence) (9C5+Rampo).

For competition with 9C5, 2 μg/ml $F_{TM-}$ protein was coated in a 96 well plate, blocked and then 20 μl periplasmic fractions was added for 30 minutes before the competitor, 9C5 (100 ng/ml) was added. They were competing for 1 hour before 1/5000 HRP conjugated rabbit anti-mouse antibody was added and incubated for 1 hour. Binding specificity was determined based on OD values compared to controls having received no NANOBODY® ($V_{HH}$ sequence). Several periplasmic fractions were found to compete with 9C5 indicating recognition of another epitope than Synagis® and 101F (FIG. 9).

Figure 10:
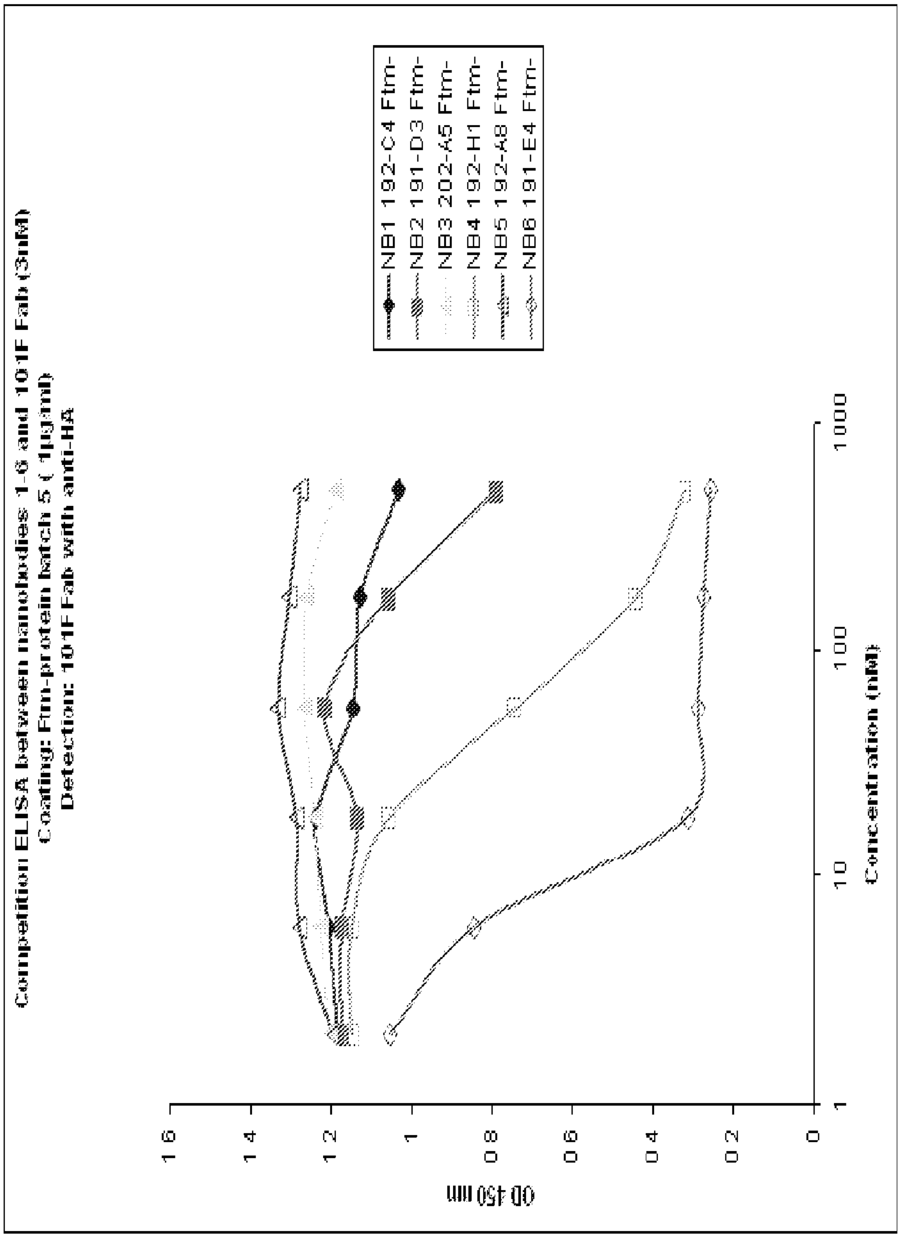
FIG. 10: Competition of NANOBODIES® ($V_{HH}$ sequences) of the invention with 101F Fab for binding to the F-protein of hRSV. NANOBODIES® ($V_{HH}$ sequences) binding hRSV $F_{TM-}$ compete with 3 nM 101F Fab, as described in Example 11. 101 Fab was detected using an anti-HA-HRP. Binding specificity was determined based on OD values compared to controls having received no NANOBODY® ($V_{HH}$ sequence).

For competition with 101F Fab, hRSV $F_{TM-}$ protein was coated in a concentration of 1 μg/ml. The plate was blocked with 1% casein and the purified NANOBODIES® ($V_{HH}$ sequences) were added starting at 500 nM and then diluted 1/3. Three nM of 101F Fab was used for competition for 1 hour before addition of mouse anti-HA (1/2000) was added. After 1 hour, HRP conjugated rabbit anti-mouse antibody was added (0.65 μg/ml). Binding specificity was determined based on OD values compared to controls having received no NANOBODY® ($V_{HH}$ sequence). Two NANOBODIES® ($V_{HH}$ sequences) were found to compete with 101F Fab, NB6 (191-E4) and NB4 (192-H1) (FIG. 10).

Example 12

Surface Plasmon Resonance for Affinity Measurements

To measure the affinity of selected NANOBODIES® ($V_{HH}$ sequences), Surface Plasmon resonance was used. For preincubation of the Sensorchip CM5, 10 μg/ml hRSV $F_{TM-}$ protein was left on for 120 seconds. For immobilization by amine coupling, EDC/NHS was used for activation and ethanolamine HCl for deactivation (Biacore, amine coupling kit). 100 nM Synagis® was added and then 100 nM of the NANOBODIES® ($V_{HH}$ sequences). Evaluation of the off-rates was performed by fitting a 1:1 interaction model (Langmuir binding model) by Biacore T100 software v1.1. The off-rates and affinity constants are shown in Table C-2. NB6 (191-E4) shows a high off-rate and the Kd was 700 pM. NB2 (191-D3) had a Kd of 2.05 nM. NB6 (191-E4) has been shown to bind to the 101F epitope and NB2 (191-D3) to the Synagis® epitope. Note that NB4 is also competing with Synagis® and may thus be recognizing yet a different epitope.

Example 13

NANOBODIES® ($V_{HH}$ Sequences) Targeting the Sialic Acid Binding Site of Influenza Hemagglutinin Hemagglutinin (HA) on Influenza viruses binds sialic acid on cells during infection. The sialic acid binding site of he HA forms a pocket which is conserved between Influenza strains. Most HAs of avian influenza viruses preferentially recognize sialic acid receptors containing the α(2,3) linkage to galactose on carbohydrate side chains (human viruses, the α(2,6) linkage). To increase the chance of isolating neutralizing NANOBODIES® ($V_{HH}$ sequences), a functional selection approach can be used—identify NANOBODIES® ($V_{HH}$ sequences) that compete with soluble 2,3 sialic acid (or 2,6 sialic acid for some mutational drift variants). This would select for NANOBODIES® ($V_{HH}$ sequences) targeting the sialic acid binding site of HA. These NANOBODIES® ($V_{HH}$ sequences) are likely to be the most potent at neutralizing H5N1.

Figure 11:
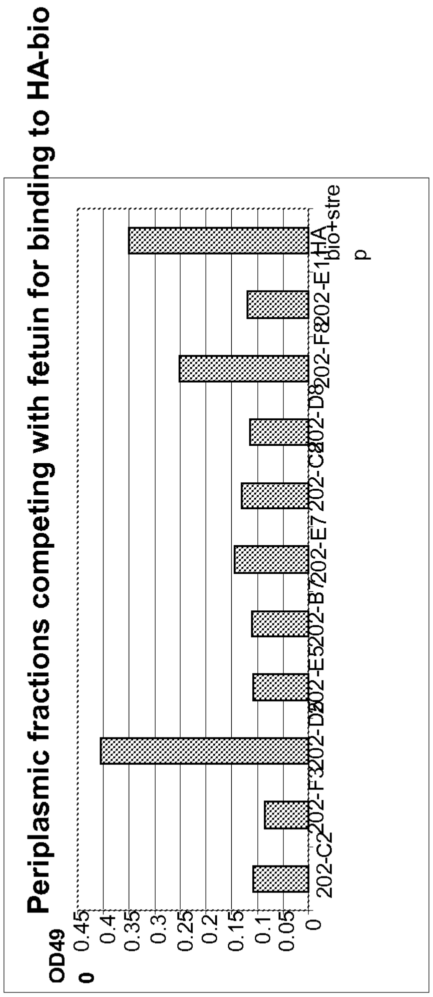
FIG. 11: Competition of NANOBODIES® ($V_{HH}$ sequences) of the invention with fetuin for binding to the hemagglutinin of influenza H5N1. 10 µl periplasmic fractions compete with fetuin for binding to 0.7 µg/ml HA-bio, as described in Example 13. Binding specificity was determined based on OD values compared to controls having received no NANOBODY® ($V_{HH}$ sequence) (HA-bio+strep).
Figure 12:
FIG. 12: Dendrogram of isolated hRSV binding NANOBODIES® ($V_{HH}$ sequences). Nine families of hRSV binding NANOBODIES® ($V_{HH}$ sequences) could be distinguished.
Figure 13:
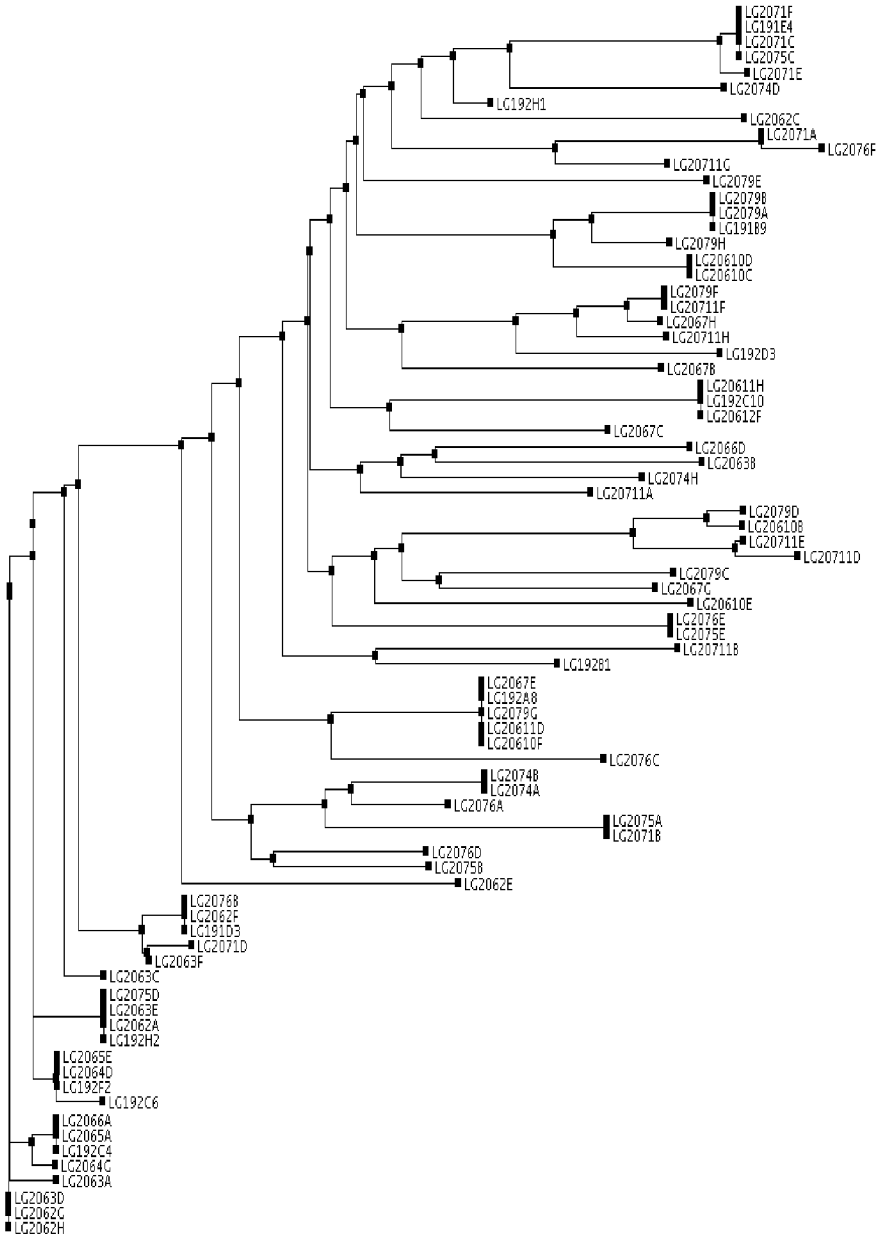
FIG. 13: Dendrogram of CDR3 sequences of isolated hRSV binding NANOBODIES® ($V_{HH}$ sequences).
Figure 14:
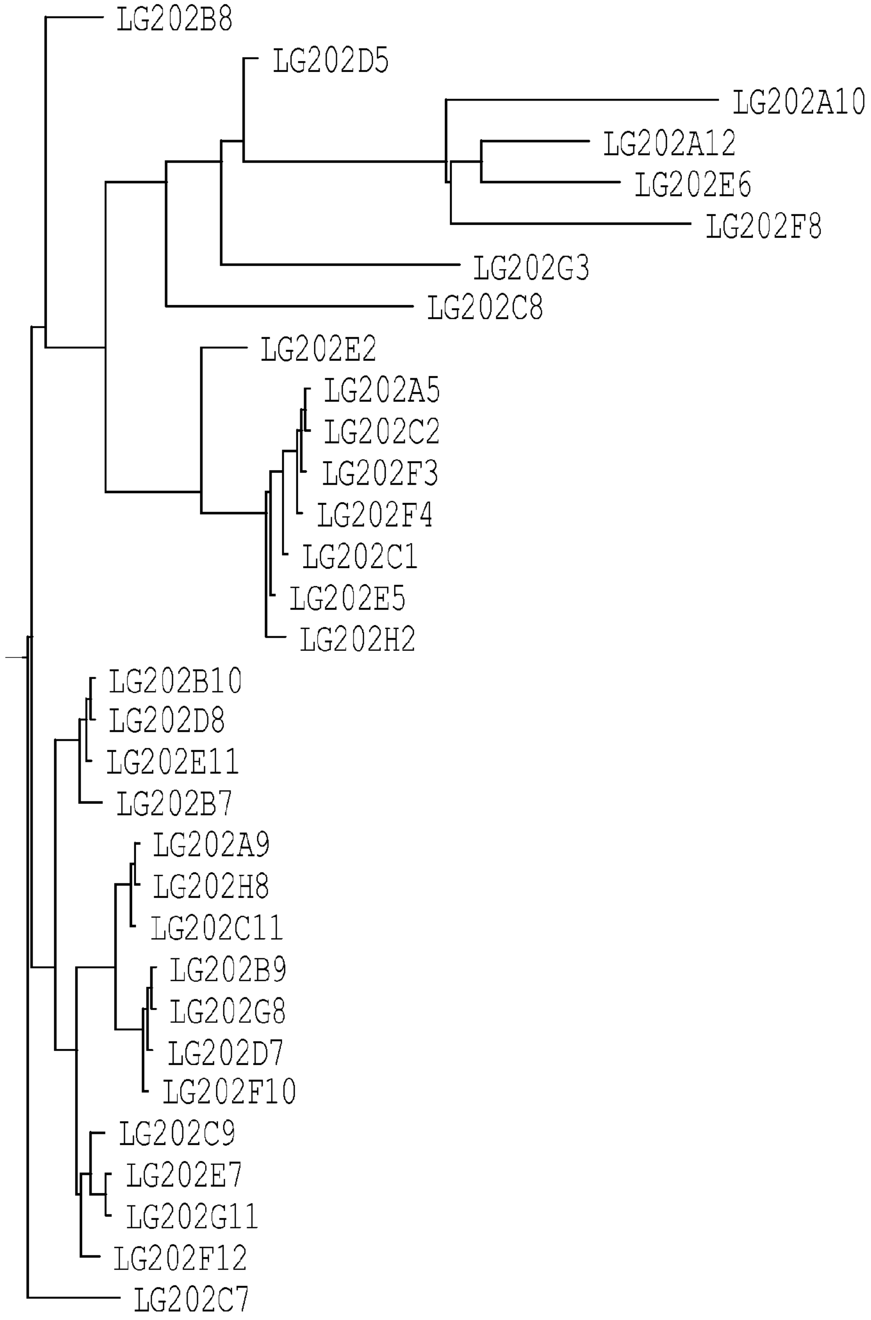
FIG. 14: Dendrogram of isolated H5 binding NANOBODIES® ($V_{HH}$ sequences). Seven families of H5 binding NANOBODIES® ($V_{HH}$ sequences) could be distinguished:
Family 1 comprises the following NANOBODIES® ($V_{HH}$ sequences): 202-B8
Family 2 comprises the following NANOBODIES® ($V_{HH}$ sequences): 202-D5
Family 3 comprises the following NANOBODIES® ($V_{HH}$ sequences): 202-A10, 202-A12, 202-E6, 202-F8
Family 4 comprises the following NANOBODIES® ($V_{HH}$ sequences): 202-G3
Family 5 comprises the following NANOBODIES® ($V_{HH}$ sequences): 202-C8
Family 6 comprises the following NANOBODIES® ($V_{HH}$ sequences): 202-A5, 202-C2, 202-F3, 202-F4, 202-C1, 202-E5, 202-H2
Family 7 comprises the following NANOBODIES® ($V_{HH}$ sequences): 202-B10, 202-D8, 202-E11, 202-B7, 202-A9, 202-H8, 202-C11, 202-B9, 202-G8, 202-D7, 202-F10, 202-C9, 202-E7, 202-G11, 202-F12, 202-C7
Figure 15:
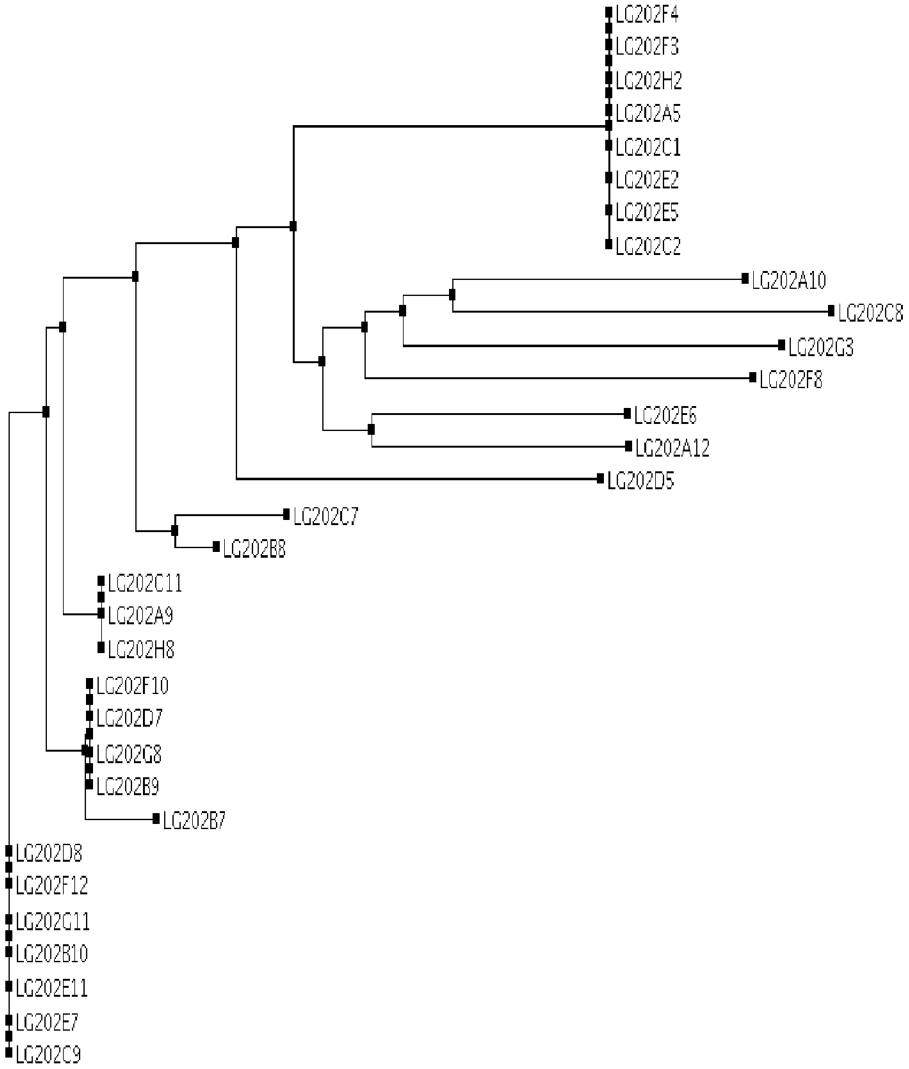
FIG. 15: Dendrogram of CDR3 sequences of isolated H5 binding NANOBODIES® ($V_{HH}$ sequences).
Figure 16:
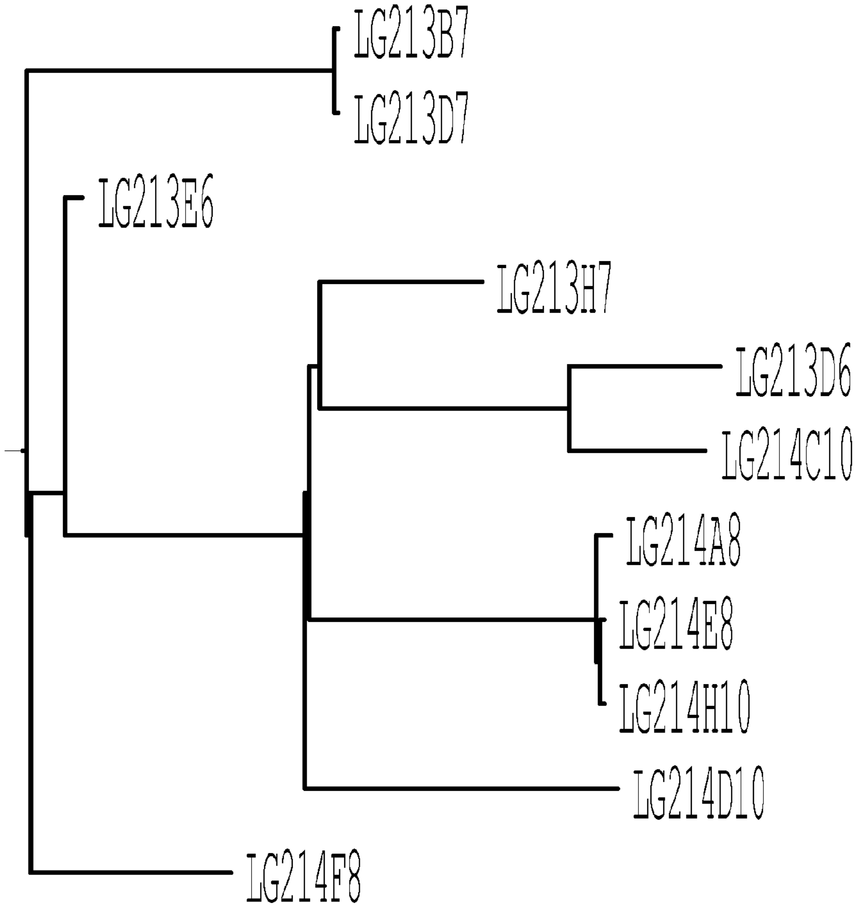
FIG. 16: Dendrogram of isolated rabies binding NANOBODIES® ($V_{HH}$ sequences). Seven families of rabies binding NANOBODIES® ($V_{HH}$ sequences) could be distinguished:
Family 1 comprises the following NANOBODIES® ($V_{HH}$ sequences): 213-B7, 213-D7
Family 2 comprises the following NANOBODIES® ($V_{HH}$ sequences): 213-E6
Family 3 comprises the following NANOBODIES® ($V_{HH}$ sequences): 213-H7
Family 4 comprises the following NANOBODIES® ($V_{HH}$ sequences): 2113-D6, 214-C10
Family 5 comprises the following NANOBODIES® ($V_{HH}$ sequences): 214-A8, 214-E8, 214-H10
Family 6 comprises the following NANOBODIES® ($V_{HH}$ sequences): 214-D10
Family 7 comprises the following NANOBODIES® ($V_{HH}$ sequences): 214-F8
Figure 17:
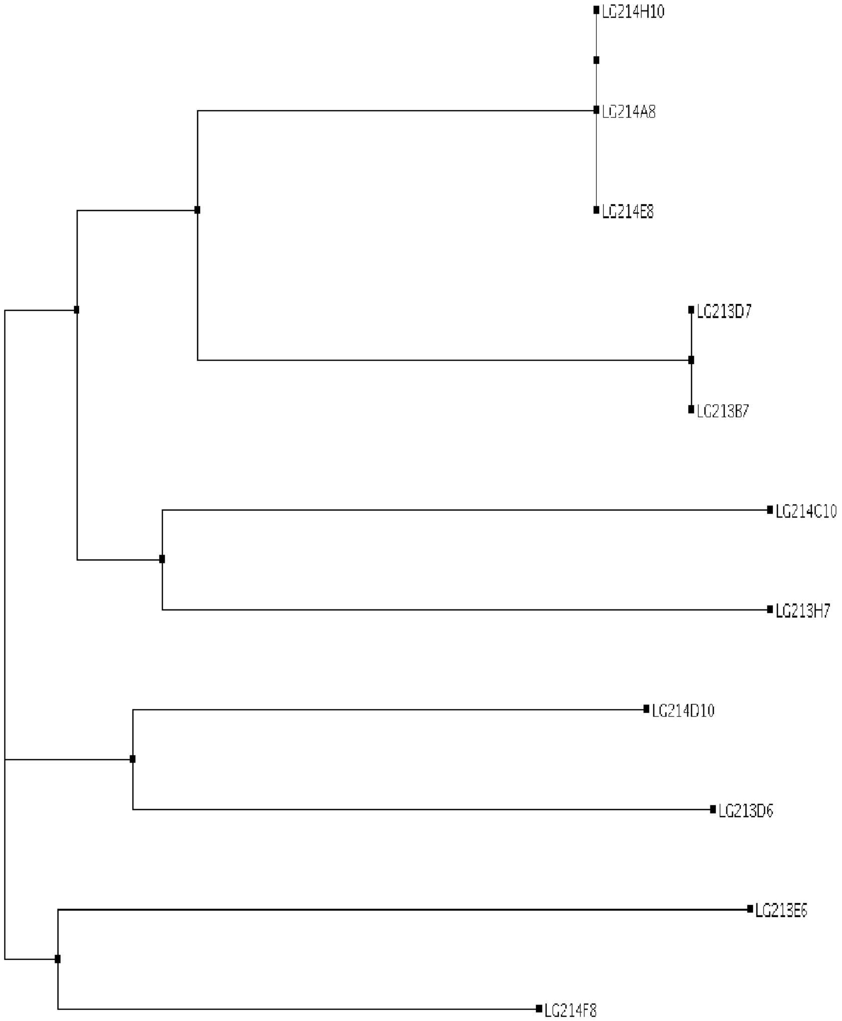
FIG. 17: Dendrogram of CDR3 sequences of isolated rabies binding NANOBODIES® ($V_{HH}$ sequences).
Figure 27:
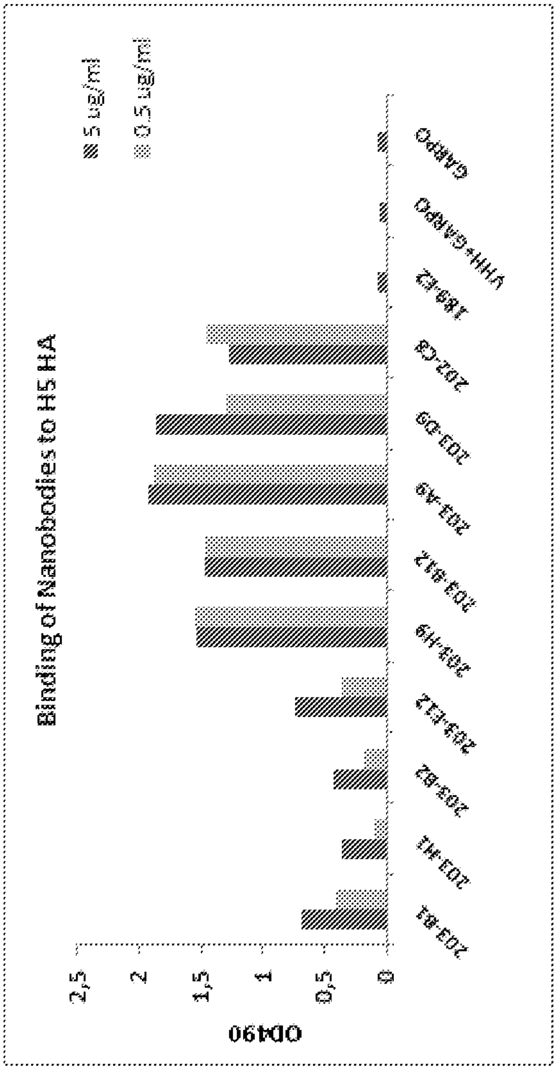
FIG. 27A: Binding assay with a dilution series of purified anti-H5 HA NANOBODIES® ($V_{HH}$ sequences).
FIG. 27B: Competition of purified NANOBODIES® ($V_{HH}$ sequences) with fetuin for binding to hemaglutinin as described in Example 13.
Figure 27:
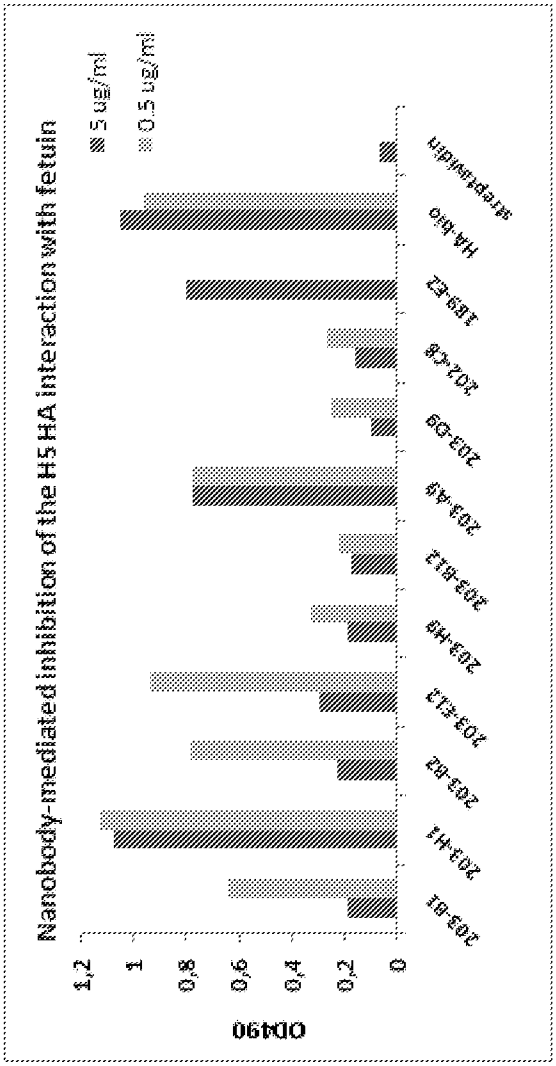

We have selected NANOBODIES® ($V_{HH}$ sequences) binding to H5N1 HA. To identify, from these NANOBODIES® ($V_{HH}$ sequences), the NANOBODIES® ($V_{HH}$ sequences) binding to the sialic acid binding site on hemagglutinin, the following experiments were performed. Fetuin (from fetal calf serum, F2379, Sigma-Aldrich, St. Louis, Mo.) was coated (10 μg/ml) in a 96 well plate and incubated over night at 4° C. The plate was blocked in 2% BSA and then 0.7 μg/ml biotinylated HA (HA-bio) and 10 μl periplasmic fractions of the NANOBODIES® ($V_{HH}$ sequences) (202-C2; SEQ ID NO: 136, 202-F3; SEQ ID NO: 150, 202-D5; SEQ ID NO: 140, 202-E5; SEQ ID NO: 145, 202-B7; SEQ ID NO: 131, 202-E7; SEQ ID NO: 147, 202-C8; SEQ ID NO: 138, 202-D8; SEQ ID NO: 142, 202-F8; SEQ ID NO: 152, 202-E11; SEQ ID NO: 143) or purified NANOBODY® ($V_{HH}$ sequence) (203-B1; SEQ ID NO: 2431, 203-H1; SEQ ID NO: 2434, 203-E12; SEQ ID NO: 2435, 203-H9; SEQ ID NO: 2445, 203-B12; SEQ ID NO: 2439, 203-A9; SEQ ID NO: 2438, 203-D9; SEQ ID NO: 2441, 202-C8; SEQ ID NO: 138, 189-E2; SEQ ID NO: 2448) were added for competition. After incubation for 1 hour, HRP conjugated streptavidin was added and incubated for 1 hour. Binding specificity of HA-bio not recognized by periplasmic fractions was determined based on OD values compared to controls having received no NANOBODY® ($V_{HH}$ sequence). Results of competition between periplasmic fractions and fetuin for binding to HA-bio is shown in FIG. 11. Results of HA binding by purified NANOBODIES® ($V_{HH}$ sequences) and of competition between purified NANOBODIES® ($V_{HH}$ sequences) and fetuin for binding to HA-bio is shown in FIGS. 27 A and B respectively. Several NANOBODY® ($V_{HH}$ sequence) clones showed competition which may indicate that the competing NANOBODIES® ($V_{HH}$ sequences) recognize the sialic acid binding site on the HA.

Example 14

In Vitro Neutralization of Virus Infection

To investigate in vitro neutralization of NANOBODIES® ($V_{HH}$ sequences) in periplasmic fractions against Rabies virus, the rabies virus neutralization assay, Rapid Fluorescent Focus Inhibition Test (RFFIT) (Standard procedure from WHO Laboratory Techniques in Rabies, 1996) was used. A standard quantity of free rabies virus was pre-incubated with different dilutions of NANOBODIES® ($V_{HH}$ sequences) in periplasmic fractions and then the periplasmic fraction-virus mixture was added on a monolayer of susceptible Baby Hamster Kidney (BHK) cells. Twenty-four hours later, cells were fixed and stained with a green-fluorescent anti-rabies conjugate to quantify infected cells. Absence of fluorescent cells indicated prior neutralization of the virus inoculum. The neutralizing capacity of the NANOBODY® ($V_{HH}$ sequence) (peri) preparations was expressed in International Units (IU)/m1 in reference to the WHO standard (=anti-rabies IgG purified from sera of vaccinated humans). The neutralization assay showed several periplasmic fractions with NANOBODIES® ($V_{HH}$ sequences) neutralizing the rabies virus (Table C-1). All neutralizing periplasmic fractions were selected against the Rabies G protein (monoclonal antibody and total elution) and showed competition with the mouse monoclonal IgG2a antibody directed against rabies virus and with neutralizing capacity. Llama sera and polyclonal periplasmic fractions selected against the inactivated virus and the G protein were included as well as controls for both the polyclonal periplasmic fractions and the monoclonal periplasmic fractions. Only polyclonal and monoclonal periplasmic fractions selected against the G protein showed neutralization.

Example 15

In Vitro Neutralization of hRSV Infection

The hRSV micro neutralization assay was used to investigate in vitro neutralization capacity of selected purified hRSV NANOBODIES® ($V_{HH}$ sequences). In here, Hep2 cells were seeded at a concentration of $1.5\times10^4$ cells/well into 96-well plates in DMEM medium containing 10% fetal calf serum (FCS) supplemented with Penicillin and Streptomycin (100 U/ml and 100 μg/ml, respectively) and incubated for 24 hours at 37° C. in a 5% $CO_2$ atmosphere. The virus stock used is referred to as hRSV strain long, Long LM-2 and Long M2 (used interchangeably) all referring to a virus stock derived from ATCC VR-26 of which the sequence of the F protein corresponds to P12568 or M22643. The virus stock has been passaged several times from the ATCC stock. The sequence of the F-protein was confirmed to be identical to P12568 (see example 23). A standard quantity of hRSV strain Long was pre-incubated with serial dilutions of purified NANOBODIES® ($V_{HH}$ sequences) in a total volume of 50 μl for 30 minutes at 37° C. The medium of the Hep2 cells was replaced with the premix to allow infection for 2 hours, after which 0.1 ml of assay medium was added. The assay was performed in DMEM medium supplemented with 2.5% fetal calf serum and Penicillin and Streptomycin (100 U/m1 and 100 μg/ml, respectively). Cells were incubated for an additional 72 hours at 37° C. in a 5% CO2 atmosphere, after which cells were washed twice with 0.05% Tween-20 in PBS and once with PBS alone, after which cells were fixed with 80% cold acetone (Sigma-Aldrich, St. Louis, Mo.) in PBS (100 μl/well) for 20 minutes at 4° C. and left to dry completely. Next the presence of the F-protein on the cell surface was detected in an ELISA type assay. Thereto, fixed Hep2 cells were blocked with 2% Bovine Serum Albumin (BSA) solution in PBS for 1 hour at room temperature, than incubated for 1 hour with anti-F-protein polyclonal rabbit serum (Corral et al. 2007, BMC Biotechnol. 7: 17) or Synagis® (2 μg/ml). For detection goat Anti-rabbit-HRP conjugated antibodies or goat Anti-Human IgG, Fcγ fragment specific-HRP (Jackson ImmunoResearch, West Grove, Pa.) was used, after which the ELISA was developed according to standard procedures.

The hRSV in vitro neutralization potency of a panel of 15 NANOBODIES® ($V_{HH}$ sequences) identified in previous examples were analyzed. The NANOBODIES® ($V_{HH}$ sequences) consisted of 4 groups:

Group 1 consisted of hRSV F protein specific NANOBODIES® ($V_{HH}$ sequences) (192C4; SEQ ID NO: 163, 191D3; SEQ ID NO: 159, 192F2; SEQ ID NO: 167, 192C6; SEQ ID NO: 164, 192H2; SEQ ID NO: 169, 192A8; SEQ ID NO: 160, 192C10; SEQ ID NO: 162) recognizing antigenic site II of the F protein. Antigenic site II (also referred to as site A) was identified by mutations found in the F protein in viral escape mutants and although antigenic site II is often found to be referred to as the region aa 250-275, antibodies typically fail to recognize linear peptides representing this region (Arbiza et al. 1992, J. Gen. Virol. 73: 2225-2234). Antibodies specific to antigenic site II may be neutralizing or not (Garcia-Barreno et al. 1989, J. Virol. 63: 925-932). Palivizumab (Synagis®) is a typical example of a mAb binding to antigenic site II (Zhao and Sullender 2005, J. Virol. 79: 3962-3968). Competition with palivizumab was used to assign the antigenic site for the Nanobod-NANOBODIES® ($V_{HH}$ sequences)ies (see example 7).

Group 2 consisted of hRSV F-protein specific NANOBODIES® ($V_{HH}$ sequences) (191E4; SEQ ID NO: 166, 192B1; SEQ ID NO: 161, 192C10; SEQ ID NO: 162) recognizing antigenic site IV-VI of the F protein (Lopez et al. 1998, J. Virol. 72: 6922). Antigenic site IV-VI was identified by mutations found in the F protein in viral escape mutants and this site can be found to be referred to as the region aa 423-436. For this antigenic site it has been shown that antibodies may recognize linear peptides (Arbiza et al. 1992, J. Gen. Vir. 73: 2225-2234). Antibodies specific to antigenic site IV-VI may be neutralizing or not (Garcia-Barreno et al. 1989, J. Virol. 63: 925-932). 101F is a typical example of a mAb binding to antigenic site IV-VI (Wu et al. 2007, J. Gen. Virol. 88: 2719-2723). Competition with a Fab of 101F was used to assign the antigenic site for the NANOBODIES® ($V_{HH}$ sequences) (see example 11).

Group 3 consisted of hRSV F-protein specific NANOBODIES® ($V_{HH}$ sequences) (192H1; SEQ ID NO: 168, 192D3; SEQ ID NO: 165, 192B1; SEQ ID NO: 161) for which the antigenic site could not be attributed, either because NANOBODIES® ($V_{HH}$ sequences) were not competing with 101F or palivizumab or they were showing competition to both 101F and palivizumab.

As controls, 3 NANOBODIES® ($V_{HH}$ sequences) specific for H5 hemagglutinin from influenza (202A5; SEQ ID NO: 128, 202G3; SEQ ID NO: 154, 202E5; SEQ ID NO: 145) were used.

Figure 18:
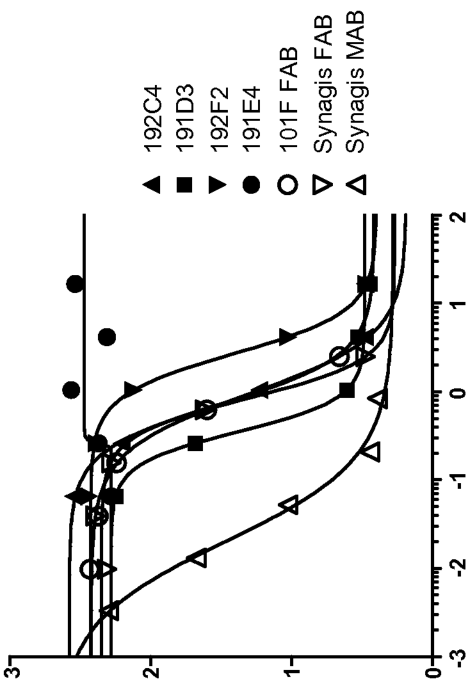
FIG. 18: Microneutralization of RSV Long LM-2 by monovalent NANOBODIES® ($V_{HH}$ sequences) and control Fabs (IC50 values are given in μM) as described in Example 15.

The neutralization assay showed that NANOBODIES® ($V_{HH}$ sequences) 191D3, 192C4 and 192F2 can neutralize RSV Long infection, with 191D3 being more potent than Synagis® Fab and 101F Fab (FIG. 18). The other NANOBODIES® ($V_{HH}$ sequences) recognizing antigenic site II could not inhibit virus infection at the highest concentration tested (3 μM).

Example 16

Immunizations

Two llamas (212 and 213) were immunized intramuscularly in the neck with 1 mg of RNA-inactivated RSV strain long A (Hytest, Turku Finland; #8RSV79), followed by 4 boosts of 0.5 mg RSV in a biweekly regimen. Two llamas (206 and 207) were immunized intramuscularly with 1 mg of RNA-inactivated RSV strain long A, boosted with 0.25 mg of RSV after 2 weeks, followed by 3 boosts with 50 μg of recombinant hRSV $F_{TM}$-NN (membrane anchorless form of the fusion protein, 70 kDa: Corral et al. 2007; BMC Biotechnol. 7: 17) in a biweekly regimen. For all immunizations the antigens were prepared as oil-PBS emulsions with Stimune as adjuvant.

For library construction, blood was collected from all animals 4 days and 10 days after the fourth immunization, while also a Lymph node biopsy was taken 4 days after the fourth immunization. For the NANOCLONE® procedure, 100 mL blood was collected 11 days after the final boost from llamas 206 and 207.

Example 17

Library Construction

Phage libraries from immune tissues of llamas 206, 207, 212 and 213 were constructed as described in Example 2.

Phage was prepared according to standard methods and stored at 4° C. for further use, making phage libraries 206, 207, 212 and 213.

Example 18

NANOBODY® ($V_{HH}$ Sequence) Selection with the F-Protein of hRSV

To identify NANOBODIES® ($V_{HH}$ sequences) recognizing the fusion protein of RSV, libraries 156, 157, 206, 207, 212 and 213 were used for selection on $F_{TM}$-NN (membrane anchorless form of the Long fusion protein, 70 kDa; Corral T. et al. 2007, BMC Biotechnol. 7: 17) as described in Example 3. In addition, selections were done using inactivated hRSV strain Long (Hytest #8RSV79). The $F_{TM}$-NN protein (25 ng/well) or RSV (5 to 50 μg/well) was immobilized on Nunc Maxisorp ELISA plates, next to a control with 0 μg/ml antigen. Bound phages were eluted from the $F_{TM}$-NN using trypsin, Synagis® (Palivizumab, humanized monoclonal antibody, described in Zhao and Sullender 2005, J. Virol. 79: 396), or 101F Fab (WO 06/050280, humanized monoclonal antibody) in the first round of selection. Outputs from the first round selections eluted with Synagis® or 101F Fab were used for second round selections, using either Numax Fab (Motavizumab or MEDI-524, a third-generation humanized monoclonal antibody product evolved from palivizumab; WO 06/050166), Synagis® or 101F Fab for elution. Remicade (Infliximab, anti-TNF) was used as a control for Synagis®, while Omnitarg Fab (anti-Her2; PCT/EP2008/066363) served as control for Numax Fab and 101F Fab. A 100 molar excess of Synagis®, Numax Fab or 101F Fab was used in order to identify NANOBODIES® ($V_{HH}$ sequences) binding specifically to antigenic sites II or IV-VI epitopes on the RSV F-protein. To obtain NANOBODIES® ($V_{HH}$ sequences) specific for the antigenic site IV-VI, second round selections were performed using two biotinylated peptides: at first, a peptide comprising residues 422-436 of the F-protein (Long) (Abgent, San Diego, Calif.) encompassing the 101F binding epitope (Wu et al. 2007, J. Gen. Virol. 88: 2719-2723), secondly, a peptide mimic of the epitope of Mab19 (HWSISKPQ-PEG4-K-biotin) (Chargelegue et al. 1998, J. Virol. 72: 2040-2056).

Outputs of both rounds of selections were analyzed for enrichment factor (phage present in eluate relative to controls). Based on these parameters the best selections were chosen for further analysis. Individual colonies were picked and grown in 96 deep well plates (1 mL volume) and induced by adding IPTG for NANOBODY® ($V_{HH}$ sequence) expression. Periplasmic extracts (volume: ~80 μl) were prepared according to standard methods.

For testing of selected clones in RSV neutralization assays, periplasmatic extracts from 10 ml cultures were partially purified by using IMAC PhyTips (Phynexus Inc, San Jose, Calif.). In here 800 μl of periplasmatic extracts was loaded onto Phytips 200+ columns prepacked with immobilized metal affinity chromatography resin, followed by elution of His-tagged NANOBODIES® ($V_{HH}$ sequences) in 30 μl of 0.1M glycine-HCl/0.15M NaCl (pH3), after which eluates were neutralized with 5 μl of 0.5M Tris-HCl pH8.5.

Example 19

NANOBODY® ($V_{HH}$ Sequence) Selection with $F_{TM}$-NN of RSV Using NANOCLONE® Technology Peripheral blood mononuclear cells (PBMCs) were prepared from blood samples using Ficoll-Hypaque according to the manufacturer's instructions. Antigen specific B-cells expressing heavy chain antibodies on their surface were isolated from the PBMCs via FACS sorting (for a description of the NANOCLONE® technology reference is made to WO 06/079372). Thereto, $F_{TM}$-NN protein was labeled with Alexa Fluor 488 dye (Invitrogen, Carlsbad, Calif.; cat. nr. A20000) and subsequently desalted to remove residual non-conjugated Alexa Fluor 488 dye according to the manufacturer's instructions.

Pre-immune (background control) and immune PBMC of a llama were stained with fluorescent dye conjugated IgG1 (conventional heavy+light chain immunoglobulins), IgG2- and IgG3 (heavy chain immunoglobulin classes) specific mouse monoclonal antibodies, fluorescently labeled DH59B antibody (CD172a) (VMRD, Inc. Pullman, Wash.; Cat No. DH59B; Davis et al. 1987, Vet. Immunol. Immunopathol. 15: 337-376) and Alexa 488 labeled antigen. TOPRO3 was included as a live/dead cell discriminator dye. IgG1+ B-lymphocytes, monocytes, neutrophils and dead cells were gated out and therefore rejected from sorting. Antigen-specific (A488+) IgG2− or IgG3 positive B cells were single cell sorted individually into separate PCR plate wells containing RT-PCR buffer.

For llama 206, 1.9% antigen positive cells of the total amount of IgG2/IgG3 positive living cells was obtained (1.0% in pre-immune reference sample), for llama 207 4.2% positive cells were obtained (0.7% in pre-immune reference sample). Heavy chain variable region genes were amplified directly from these B-cells by single-cell RT-PCR and nested PCR. PCR products were subsequently cloned into a TOPO-adapted expression vector derived from pUC119 which contained the LacZ promoter, a resistance gene for ampicillin or carbenicillin, a multicloning site and the gen3 leader sequence. In frame with the NANOBODY® ($V_{HH}$ sequence) coding sequence, the vector coded for a C-terminal c-myc tag and a (His)6 tag. The resulting constructs were transformed in TOP10 *Escherichia coli* cells via high throughput electroporation. Single clones were grown in 96 deep well plates (1 ml volume) and induced by adding IPTG for NANOBODY® ($V_{HH}$ sequence) expression. Periplasmic extracts (volume: ~80 μl) were prepared via osmotic shock and analyzed for binding to $F_{TM}$- in a binding ELISA as described in example 6. In total, 8 positive $F_{TM}$-NN binders (4 from llama 206, 4 from llama 207) were obtained out of 52 cloned VHHs.

Example 20

Screening for NANOBODIES® ($V_{HH}$ Sequences) that Bind to Antigenic Site II or IV-VI Periplasmic extracts containing single NANOBODIES® ($V_{HH}$ sequences) were analyzed for binding to the antigen site II or IV-VI, using an Alphascreen® assay (Perkin Elmer; Waltham, Mass.) (Garcia-Barreno et al. 1989, J. Virol. 63: 925-932). In this setup $F_{TM}$-NN is bound simultaneously by Fabs of Synagis® and 101F, allowing detection of NANOBODIES® ($V_{HH}$ sequences) that interfere with binding of each of the respective antigenic sites II and IV-VI. In here, periplasmic extracts were added to $F_{TM}$-NN protein (0.3 nM) and incubated for 15 minutes. Subsequently biotinylated Fab Synagis® (0.3 nM) and Fab 101F conjugated acceptor beads (10 μg/ml) were added and this mixture was incubated for 1 hour. Finally streptavidin-coated donor beads (10 μg/ml) were added and after 1 hour incubation the plate was read on the Envision microplate reader. Periplasmic extracts were diluted 25-fold which corresponds roughly to a final concentration of 40 nM.

The assay was validated by titration of the known competitors of Synagis®, mabs 18B2 (Argene, Varilhes, France; 18042 N1902) and 2F7 (Abcam, Cambridge, UK; ab43812). Also Synagis® Fab, Numax Fab, and 101F Fab were analyzed, with Numax Fab having the lowest IC50 value (8.6 E-11 M) followed by Synagis® Fab (5.97 E-10 M) and 101F Fab (1.12 E-9 M). For the screening of periplasmatic extracts (at 1/25 dilution) both Numax Fab (40 nM) and 101F Fab (40 nM) were used as positive controls, while irrelevant periplasmatic extracts served as negative controls. Clones that interfered with binding to $F_{TM}$-NN protein in the Alphascreen® more than 75% relative to the negative controls were identified as hit. In total 341 hits were identified out of 1856 clones, derived from all 6 llamas but the majority coming from llamas 206 and 207. In addition, out of 8 clones obtained from NANOCLONE® selections 3 clones showed competition.

The correct antigen site (II or IV-VI) of the competitors was deconvoluted by means of a competition ELISA with biotinylated Synagis® Fab (2 nM) or biotinylated 101F Fab (3 nM) for binding to $F_{TM}$-NN protein (1 μg/ml). The protocol is essentially the same as described in example 7, with the following modifications. Periplasmatic extracts were diluted 1/10 and mixed with the biotinylated Fab prior to binding to the immobilized $F_{TM}$-NN protein. Detection occurred via Extravidin-HRP conjugated secondary antibodies (Sigma-Aldrich, St. Louis, Mo.; Cat. No. E2886).

All hits were subjected to sequence analysis and classified into families according to their CDR3 sequences. In total 133 unique sequences were derived from llamas 206, 207, 212 and 213, classified into 34 different families (Table C-4). Only 6 families containing 15 unique sequences were classified as binding antigenic site II. All remaining clones were binding antigenic site IV-VI. Eight sequences were non-competing binders identified in binding ELISA to hRSV. Also five new families were identified from libraries 156 and 157, of which one identified as binding antigenic site II, and the remaining as binding antigenic site IV-VI. Also new family members of previously identified families from llamas 156 and 157 were identified.

Example 21

Screening for RSV Neutralizing NANOBODIES® ($V_{HH}$ Sequences)

From all six hRSV libraries 163 unique sequences (160 identified from phage libraries, 3 derived from NANOCLONE®) were analyzed for RSV Long neutralizing capacity in a micro-neutralization assay as partially purified proteins. The screening was essentially performed as described in example 15, using a fixed volume of Phytips purified NANOBODIES® ($V_{HH}$ sequences) (20 μl). The detection of F-protein on the Hep2 cell surface was done using Synagis® (2 μg/ml), followed by goat Anti-Human IgG, Fcγ fragment specific-HRP (Jackson ImmunoResearch, West Grove, Pa.).

In addition to the previously identified RSV neutralizing NANOBODIES® ($V_{HH}$ sequences) LG191D3 and LG192C4, which were included as positive controls in the screening, 5 new antigenic site II clones showed strong RSV Long neutralizing activity: 1E4 (also referred to as 207D1; SEQ ID NO: 211), a newly identified family member of 191D3 (SEQ ID NO: 159), 7B2 (SEQ ID NO: 364), NC23 (SEQ ID NO: 380), and two members of the same family 15H8 (SEQ ID NO: 371) and NC41 (SEQ ID NO: 372) (Tables A-1, C-4). None of the antigenic site IV-VI specific NANOBODIES® ($V_{HH}$ sequences) showed more than very weak neutralizing activity for hRSV Long LM-2 strain.

Example 22

Construction, Production and Characterization of hRSV NANOBODIES® ($V_{HH}$ Sequences)

Five new neutralizing NANOBODIES® ($V_{HH}$ sequences) selected from the screening described above (1E4, 7B2, 15H8, NC23 and NC41) as well as 2 antigenic site IV-VI NANOBODIES® ($V_{HH}$ sequences) (NC39; SEQ ID NO: 359, 15B3; SEQ ID NO: 286) were expressed, purified and further characterised. Thereto the encoding sequences were recloned in an expression vector derived from pUC119 which contained the LacZ promoter, a resistance gene for kanamycin, a multicloning site and the OmpA signal peptide sequence. In frame with the NANOBODY® ($V_{HH}$ sequence) coding sequence, the vector coded for a C-terminal c-myc tag and a (His)6 tag.

Expression occurred in *E. coli* TG-1 cells as c-myc, His6-tagged proteins in a culture volume of 1 L. Expression was induced by addition of 1 mM IPTG and allowed to continue for 3 hours at 37° C. After spinning the cell cultures, periplasmic extracts were prepared by freeze-thawing the pellets and resuspension in dPBS. These extracts were used as starting material for immobilized metal affinity chromatography (IMAC) using Histrap FF crude columns (GE healthcare, Uppsala, Sweden). NANOBODIES® ($V_{HH}$ sequences) were eluted from the column with 250 mM imidazole and subsequently desalted towards dPBS.

All purified NANOBODIES® ($V_{HH}$ sequences) were shown to bind to the F-protein in a binding ELISA to $F_{TM}$-NN protein and to hRSV. Results for hRSV binding are shown in Table C-5. In short, 1 μg/ml of $F_{TM}$-NN or 5 μg/ml hRSV (Hytest Turku, Finland) were immobilized directly on Maxisorp microtiter plates. Free binding sites were blocked with 1% casein. Serial dilutions of purified NANOBODIES® ($V_{HH}$ sequences) were allowed to bind the antigen for 1 hour. NANOBODY® ($V_{HH}$ sequence) binding was revealed using a rabbit-anti-VHH secondary antibody, and final detection with a HRP-conjugated goat-anti-rabbit antibody. Binding specificity was determined based on OD values compared to irrelevant NANOBODY® ($V_{HH}$ sequence) controls.

To determine the precise binding affinities of the purified NANOBODIES® ($V_{HH}$ sequences), a kinetic analysis was performed using Surface Plasmon resonance analysis on the $F_{TM}$-NN protein, following the procedure described in example 12. Results are shown in Table C-5.

Figure 19:
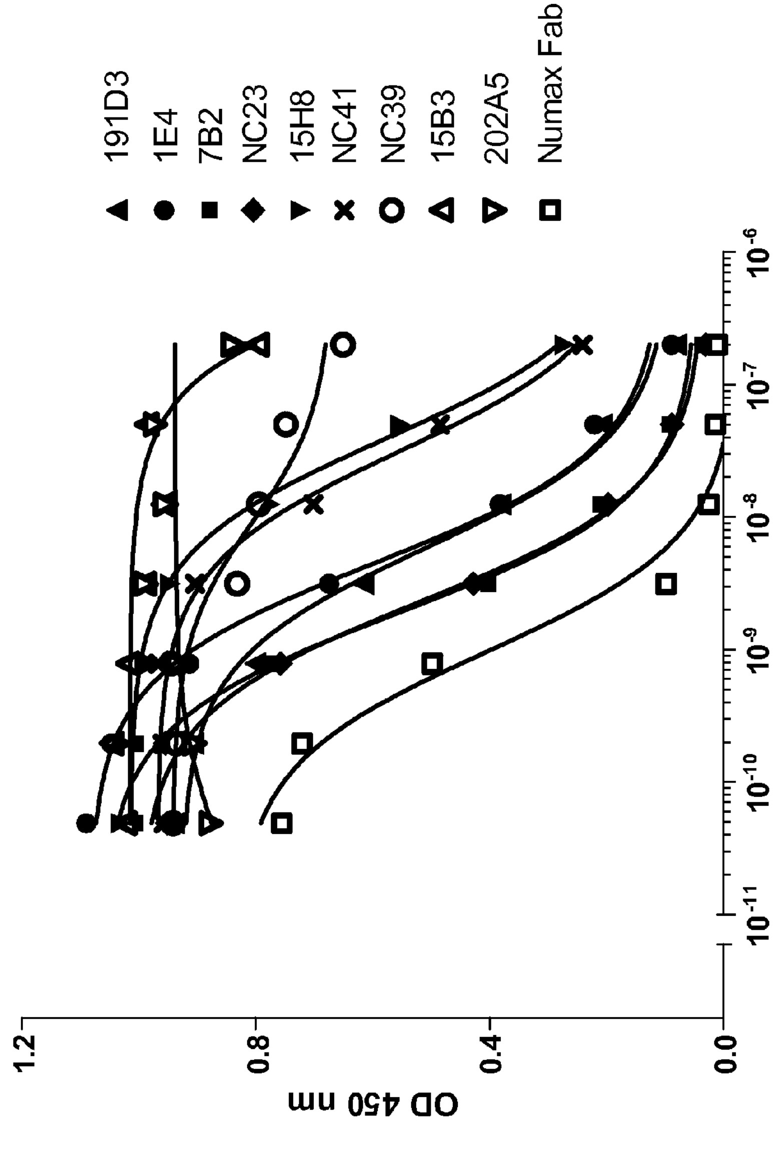
FIG. 19: Competition ELISA: Synagis® Fab competes with purified RSV binding NANOBODIES® ($V_{HH}$ sequences) for binding to $F_{TM}$- protein as described in Example 22.

The ability of purified NANOBODIES® ($V_{HH}$ sequences) to compete with Synagis® Mab or biotinylated Synagis® Fab for binding to $F_{TM}$-NN was determined in ELISA following the procedure described in examples 8 and 20. FIG. 19 shows a representative example of a competition ELISA wherein purified NANOBODIES® ($V_{HH}$ sequences) compete with biotinylated Synagis® Fab for binding to $F_{TM}$-NN. As summarized in Table C-5, the six RSV neutralizing NANOBODIES® ($V_{HH}$ sequences) all competed with Synagis®, albeit to different extents. NANOBODIES® ($V_{HH}$ sequences) 15H8 and NC41 competed to a lesser extend, which may indicate an altered binding epitope within antigenic site II than the other NANOBODIES® ($V_{HH}$ sequences).

NANOBODIES® ($V_{HH}$ sequences) 15H8 and NC41 also had relatively low affinities ($K_D$ values of 16 and 8.1 nM, respectively). NANOBODIES® ($V_{HH}$ sequences) 7B2 and NC23 showed off-rates in the $10^{-4}$ (1/s) range, resulting in $K_D$ values around 1 nM, confirming the strong binding to hRSV observed in ELISA. NANOBODIES® ($V_{HH}$ sequences) 191D3 and 1E4 showed low nM affinities due to very high on-rates. The antigenic site IV-VI binders 15B3 and 191E4 show the highest affinities for $F_{TM}$-NN of the panel with sub-nanomolar affinities.

Example 23

In Vitro Micro Neutralization of Distinct hRSV Strains

The potency of purified NANOBODIES® ($V_{HH}$ sequences) in neutralization of different type A and B RSV strains was tested by the in vitro micro neutralization assay (see example 15). Viral stocks of RSV Long (Accession No. P12568; ATCC VR-26; see example 15), RSV A-2 (ATCC VR-1540; lot nr. 3199840) and RSV B-1 (ATCC VR-1580; lot nr. 5271356) were prepared into Hep2 cells and subsequently titrated to determine the optimal infectious dose for use in the micro neutralization assay. Results of neutralization potencies of the different purified NANOBODIES® ($V_{HH}$ sequences) are shown in Table C-5. While all six NANOBODIES® ($V_{HH}$ sequences) that recognize the Synagis® epitope could efficiently neutralize type A strains Long and A-2, they failed to neutralize infection with the B-1 strain or did so at concentrations >1 μM. The 101F competitors 15B3 and 191E4 showed very weak neutralization potency on the B-1 strain only when administrated at μM concentrations.

The sequences of the respective F-proteins of the different RSV strains were verified by means of reverse-transcriptase PCR and subsequent sequence analysis. Briefly, total RNA was isolated from RSV-infected Hep2 cells using RNeasy mini kit (Qiagen, Venlo, Netherlands), after which complementary DNA was prepared using Superscript III reverse transcriptase kit (Invitrogen, Carlsbad, Calif.). The F-protein of RSV A strains was amplified and sequenced using the primers described in Kimura et al. 2004 (Antiviral Research 61: 165-171). For amplification of the RSV B-1 strain F-protein the following primers were used: FB1_outer_for: cttagcagaaaaccgtga (SEQ ID NO: 2419); FB1_outer_rev: tgggttgatttgggattg (SEQ ID NO: 2420); FB1_seq__1123-for: ggactgatagaggatggta (SEQ ID NO: 2421); FB1_seq__1526-rev: gctgacttcacttggtaa (SEQ ID NO: 2422). The sequence of RSV B-1 strain corresponded to Accession nr P13843, with an additional point mutation Ser540Leu. The sequence for the RSV Long M2 strain corresponded completely to the reported sequence (Accession nr M22643). The sequence for the strain RSV A-2 corresponded to Accession M11486. See also Table A-3.

Example 24

Construction, Production and Characterization of Multivalent hRSV NANOBODIES® ($V_{HH}$ Sequences)

Multivalent NANOBODY® ($V_{HH}$ sequence) constructs connected by Gly-Ser linkers of different lengths and composition were generated by means of separate PCR reactions (1 for the N-terminal, 1 for the middle (in case of trivalent) and 1 for the C-terminal NANOBODY® ($V_{HH}$ sequence) subunit) using different sets of primers encompassing specific restriction sites. Similarly, multivalent NANOBODY® ($V_{HH}$ sequence) constructs connected by Ala-Ala-Ala linker were generated. All constructs were cloned into an expression vector derived from pUC119 which contained the LacZ promoter, a resistance gene for kanamycin, a multicloning site and the OmpA signal peptide sequence. In frame with the NANOBODY® ($V_{HH}$ sequence) coding sequence, the vector coded for a C-terminal c-myc tag and a (His)6 tag. In case a 35 Gly-Ser-linker was present in the multivalent construct, an expression vector was used derived from pUC119 which contained the LacZ promoter, a resistance gene for kanamycin and the OmpA signal peptide sequence. Directly downstream of the signal peptide a multiple cloning site was present for NANOBODY® ($V_{HH}$ sequence) insertion, followed by a 35Gly-Ser linker encoding DNA sequence and a second multiple cloning site for cloning of a second NANOBODY® ($V_{HH}$ sequence) sequence. In frame with the resulting NANOBODY® ($V_{HH}$ sequence)-35Gly-Ser-NANOBODY® ($V_{HH}$ sequence) coding sequence, the vector coded for a C-terminal c-myc tag and a (His)6 tag. Table C-6 lists the multivalent constructs generated with RSV-specific NANOBODIES® ($V_{HH}$ sequences). The sequences of the multivalent constructs are shown in Table A-2.

Multivalent RSV NANOBODY® ($V_{HH}$ sequence) constructs were expressed, purified and further characterized. Production was done in *E. coli* TG1 cells, followed by purification from the periplasmic fraction via the His-tag by IMAC and desalting, essentially as described in example 22. For certain trivalent constructs (e.g. RSV401, RSV404, RSV406) production was done in *P. pastoris* followed by purification from the medium fraction. All trivalent NANOBODIES® ($V_{HH}$ sequences) were subjected to gel filtration as a final step to remove possible bivalent and monovalent degradation products.

Figure 20:
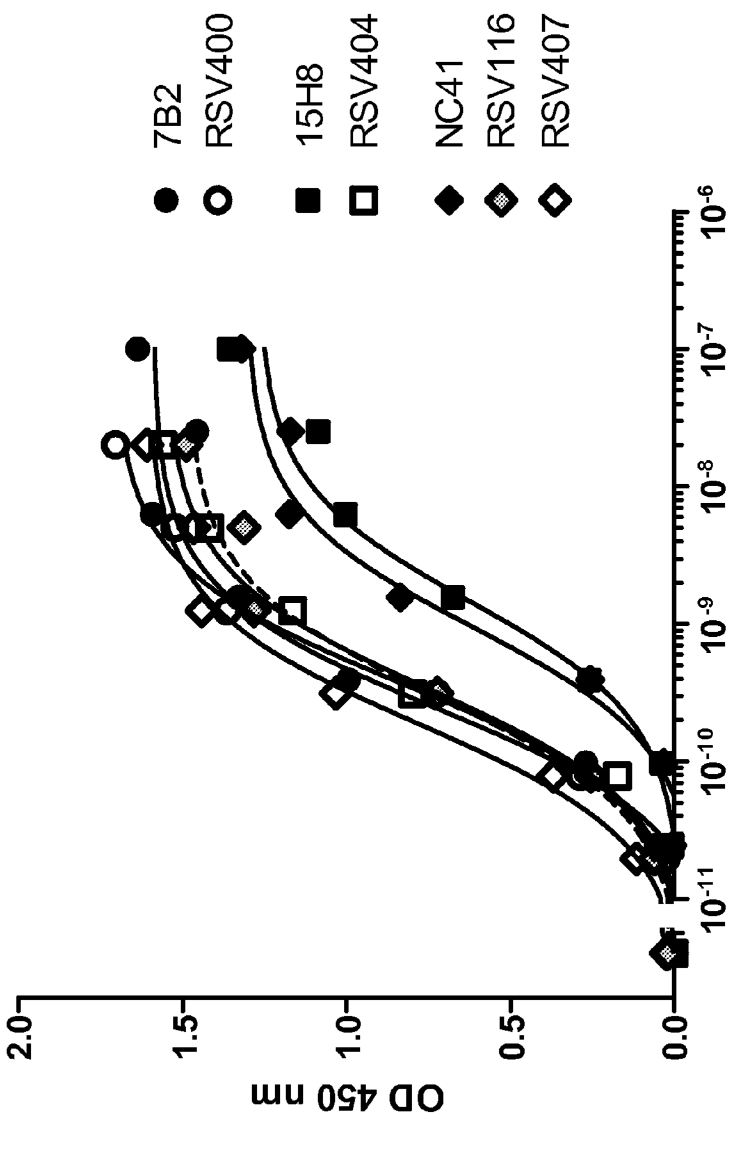
FIG. 20: Binding of monovalent, bivalent and trivalent NANOBODIES® ($V_{HH}$ sequences) to $F_{TM}$- protein as described in Example 24.

Binding of purified multivalent NANOBODIES® ($V_{HH}$ sequences) to the hRSV F-protein was confirmed in ELISA on both $F_{TM}$- protein and on hRSV (see example 22). For the majority of NANOBODIES® ($V_{HH}$ sequences) the formatting into bivalent and trivalent constructs resulted in a clear but limited (up to 10-fold increase) avidity effect, with the exception of multivalents of 7B2 and NC23 which showed similar EC50 values as their monovalent counterparts (FIG. 20).

Example 25

Potency of Bi- and Trivalent Constructs to Neutralize hRSV

Figure 21:
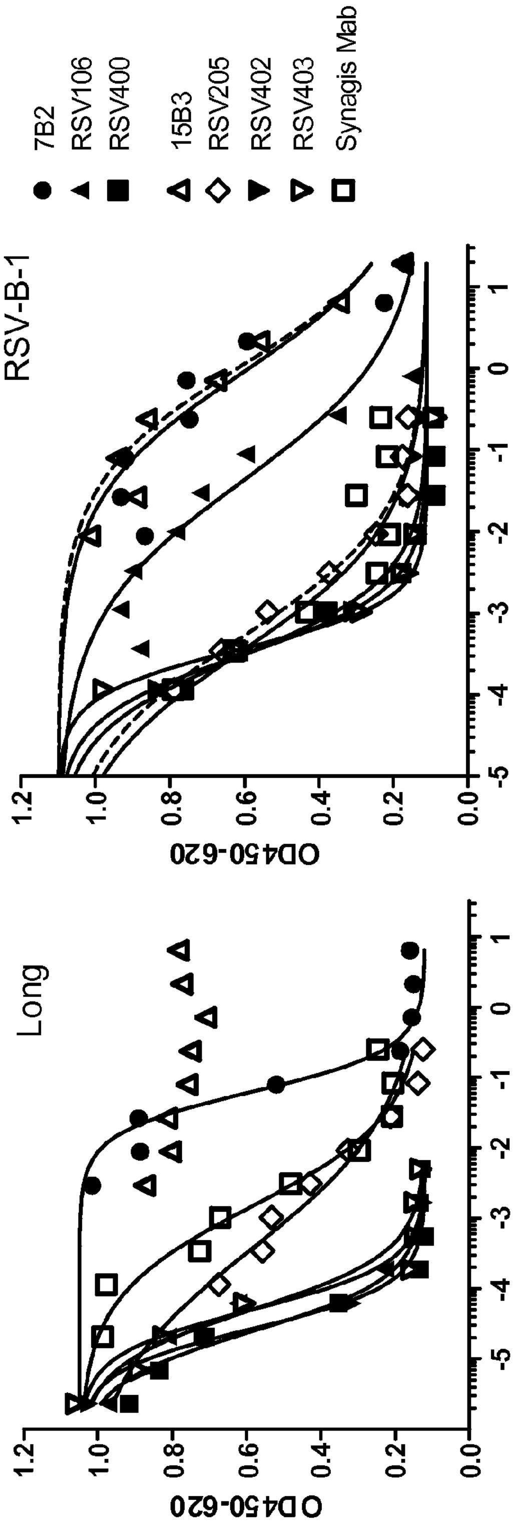
FIGS. 21A and B: Potency of monovalent, bivalent and trivalent constructs to neutralize Long and B-1 RSV strains as described in Example 25.
Figure 21:
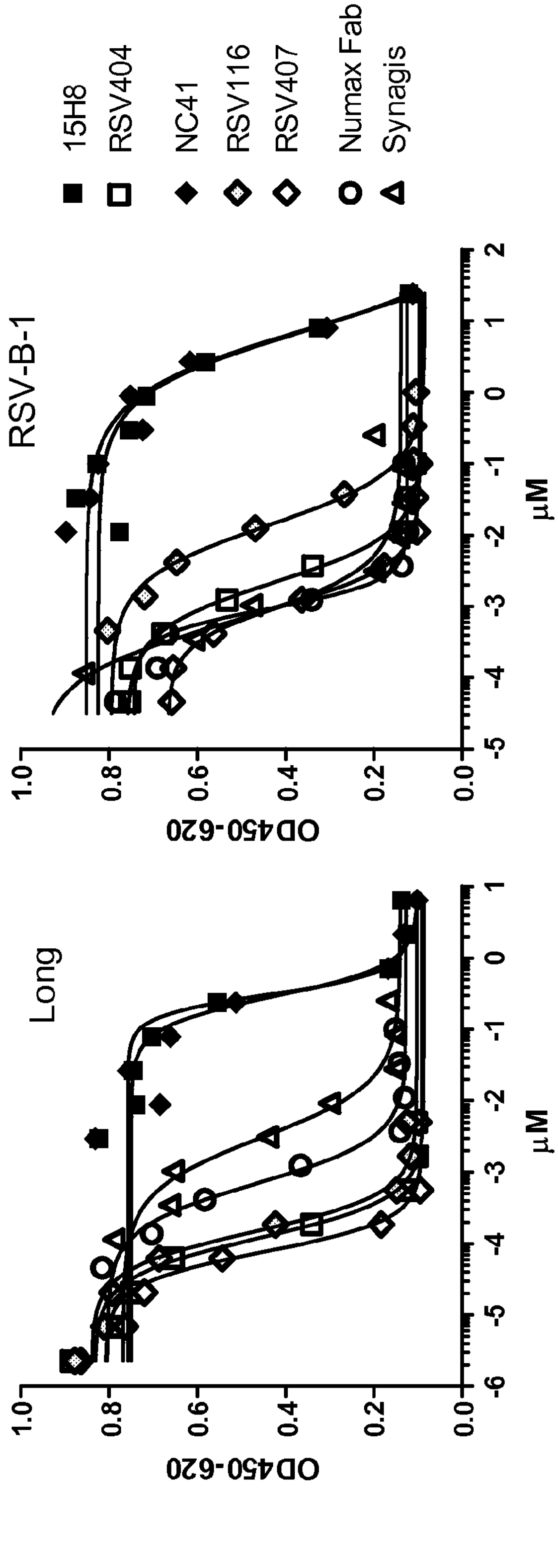

The potency of the NANOBODY® ($V_{HH}$ sequence) constructs was evaluated in the RSV neutralization assay on different RSV strains (see examples 15 and 23). Bivalent NANOBODIES® ($V_{HH}$ sequences) binding antigenic site II showed marked increases in potencies of 100- to 1000-fold (i.e. much higher than the increase in affinity) in neutralization of Long relative to their monovalent counterparts, with IC50 values ranging from 50-380 pM, being better or similar to Numax Fab. On the RSV B-1 strains however, the potency increase was much less strong, and none of the dimeric constructs was more potent than Synagis®. Surprisingly, this could be overcome by the generation of trivalent constructs, as shown in FIG. 21. Trivalent constructs with three NANOBODIES® ($V_{HH}$ sequences) binding antigenic site II were at least 1000-fold more potent neutralizers on RSV B-1 strains than their monovalent counterparts.

Figure 22:
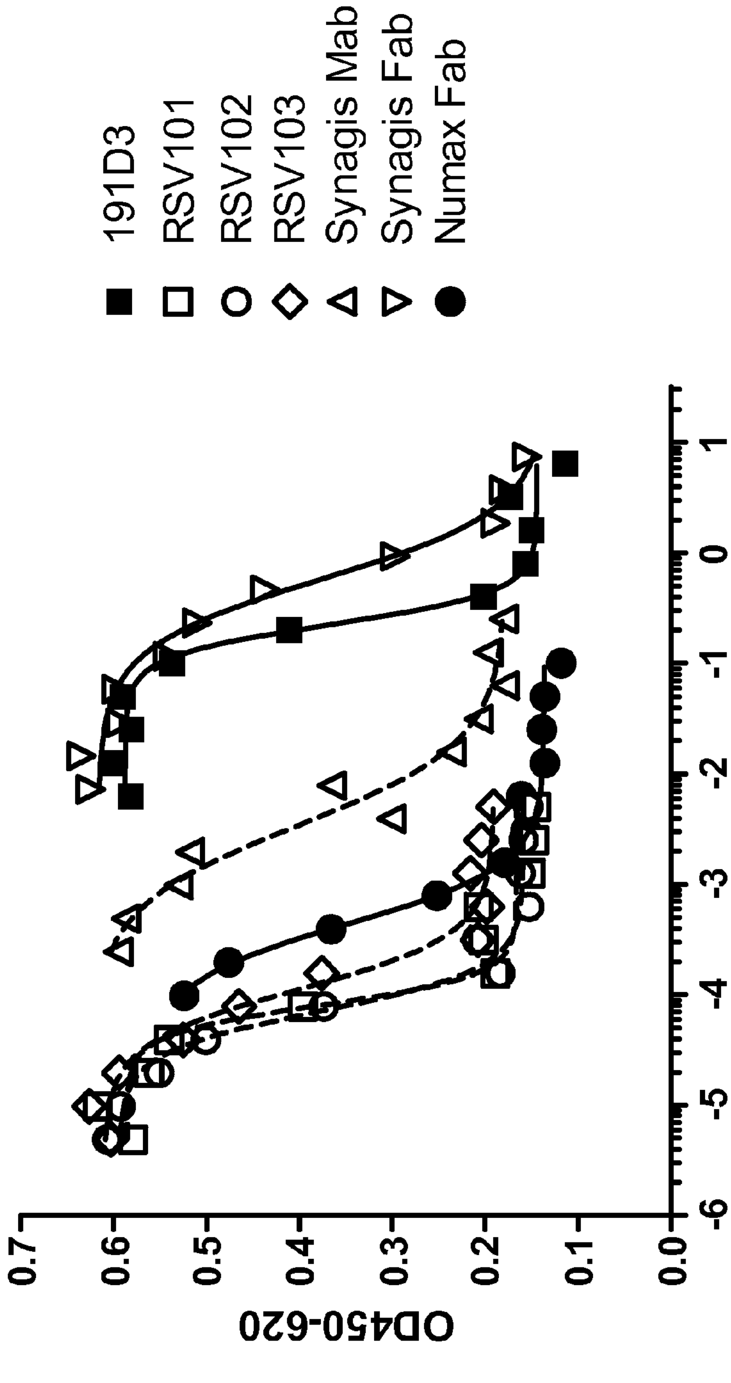
FIG. 22: Neutralization of RSV Long by bivalent 191D3 NANOBODIES® ($V_{HH}$ sequences) with different linker lengths as described in Example 25.

FIG. 22 illustrates that the linker length did not have a clear effect on the gain in potency of bivalent 191D3 constructs compared to monovalent 191D3.

Example 26

Potency of Bi- and Trivalent Biparatopic Constructs to Neutralize hRSV

Figure 23:
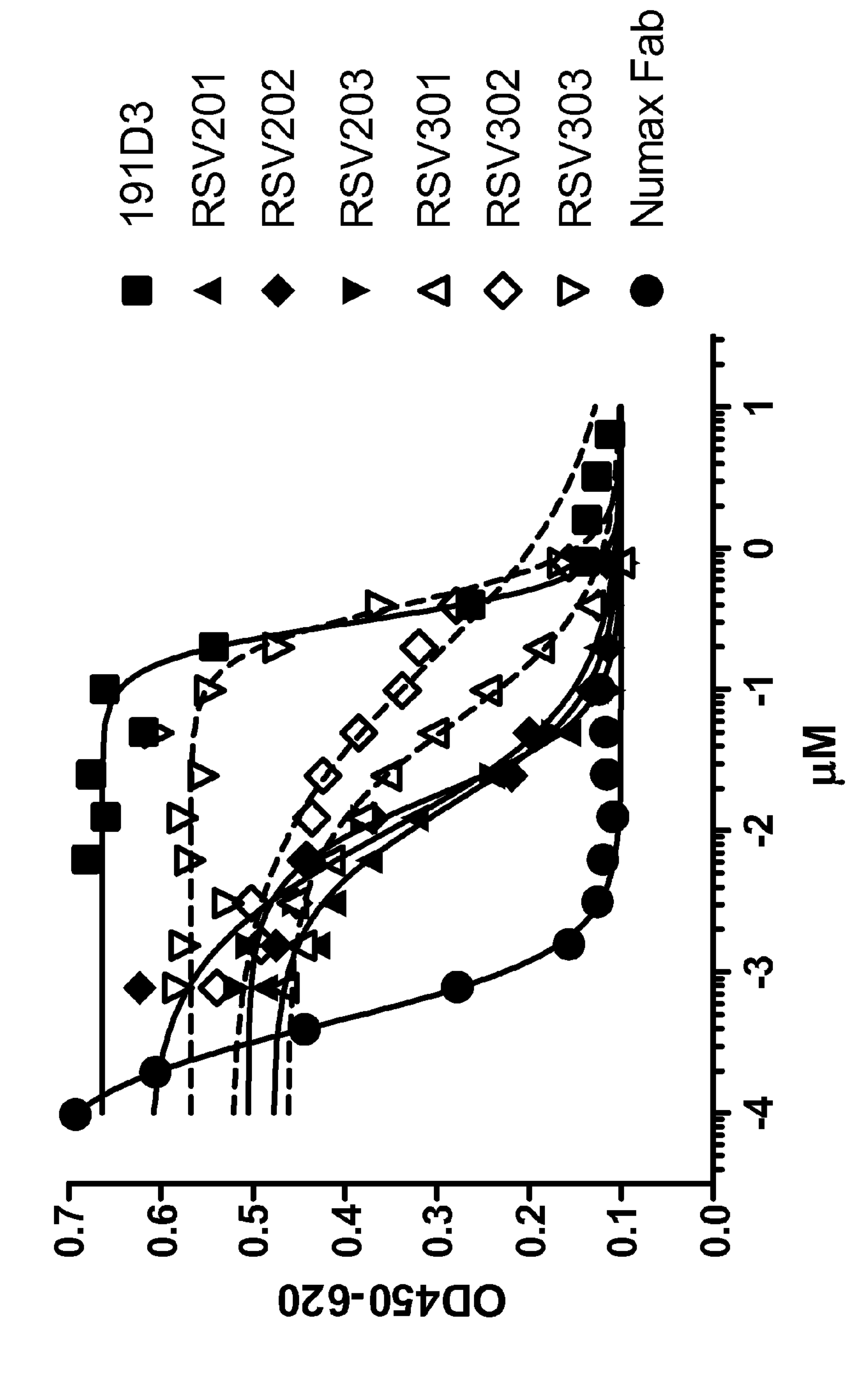
FIG. 23: Neutralization of RSV Long by biparatopic NANOBODIES® ($V_{HH}$ sequences) of 191D3 (antigenic site II) and 191E4 (antigenic site IV-VI) as described in Example 26: effect of orientation and linker lengths.

Biparatopic constructs consisting of one NANOBODY® ($V_{HH}$ sequence) binding antigenic site II and one NANO- BODY® ($V_{HH}$ sequence) binding antigenic site IV-VI were analysed for neutralization. Biparatopic-bivalent constructs generally showed a flatted curve in the neutralization assay, hampering accurate determination of IC50 values (FIGS. 21, 23). In spite of this, neutralization was improved significantly on both strains (see e.g. RSV205; FIG. 21). This remarkable gain in function was also noted for a second pair of antigenic site II and IV-VI binders, 191D3-191E4. For this pair different linker lengths and orientations were compared, showing that shortening of the linker length clearly enhances the IC50, but only for one orientation (FIG. 23).

Also biparatopic constructs with two different NANOBODIES® ($V_{HH}$ sequences) binding to antigenic site II, 7B2 and 15H8, were analysed for neutralization (RSV204 and 206). Also in this case significant improvement in potency was noted especially for the B-1 strain were potency increased at least 1000-fold versus the monomeric NANOBODIES® ($V_{HH}$ sequences).

Trivalent biparatopic constructs of 7B2 and 15B3 were even more potent neutralizers of both Long and B-1 strains and did not show the flattened curves as observed with bivalent biparatopic constructs (FIG. 21).

Example 27

Reactivity of Monovalent NANOBODIES® ($V_{HH}$ Sequences) with Escape Mutants of the Long Strain A number of escape mutants, described in Lopez et al. 1998 (J. Virol. 72: 6922-6928), and specific for antigenic site II (R47F/4, R47F/7, RAK13/4, R7C2/11, R7C2/1) or IV-VI (R7.936/1, R7.936/4, R7.936/6, R7.432/1) or the combination of both (RRA3), were selected for testing their reactivity with 10 monovalent NANOBODIES® ($V_{HH}$ sequences), including NANOBODY® ($V_{HH}$ sequence) 191 C7 (EVQLVESGGGLVQAGGSLRLSCAASGSS-GVINAMAWHRQAPGKERELVAHISSGGS TYYGD-FVKGRFTISRDNAKDTVYLQMNSLKPED-TAVYYCHVPWMDYNRRDYWGQ GTQVTVSS; SEQ ID NO: 2423) previously identified as not binding to antigenic sites II or IV-VI.

This assay was performed according to Lopez et al. 1998 (J. Virol. 72: 6922-6928). In brief, each NANOBODY® ($V_{HH}$ sequence) was tested at 0.2 μg/ml in ELISA using antigen extracts of HEp-2 cells infected with the different escape mutants. Absorbance results were normalized for reactivity on the reference virus strain (Long wild type) strain as well as on the control NANOBODY® ($V_{HH}$ sequence) 191C7. Results are shown in Table C-7.

A reactivity of >75% is indicated as a filled black square, dark hatched squares correspond to a reactivity between 75 and 50%, light hatched squares correspond to a reactivity of 25-50% and less than 25% reactivity is indicated by a blank square. In general NANOBODIES® ($V_{HH}$ sequences) already identified as antigenic site II binders in previous examples (192C4, 191D3, 191F2, NC23, 15H8, 7B2 and NC41) were found to be sensitive to typical mutations in antigenic site II, while the other NANOBODIES® ($V_{HH}$ sequences) already identified as antigenic site IV-VI binders were indeed sensitive for mutations in these sites.

Example 28

Reactivity of Multivalent NANOBODIES® ($V_{HH}$ Sequences) with Escape Mutants of the Long Strain Subsequently a number of multivalent constructs was analyzed on a limited panel of escape viruses to assess binding. This assay was performed according to Lopez et al. 1998 (J. Virol. 72: 6922-6928). In brief, each NANOBODY® ($V_{HH}$ sequence) was tested at 0.1 μg/ml for monovalent NANOBODIES® ($V_{HH}$ sequences) and at 0.05 μg/ml for bi- and trivalent NANOBODIES® ($V_{HH}$ sequences) in ELISA using antigen extracts of HEp-2 cells infected with the different escape mutants. Absorbance results were normalized for reactivity on the reference virus strain (Long wild type) strain as well as on the control NANOBODY® ($V_{HH}$ sequence) (191E4; SEQ ID NO: 166, in this particular assay). Results are shown in Table C-8.

A reactivity of >75% is indicated as a filled black square, dark hatched squares correspond to a reactivity between 75 and 50%, light hatched squares correspond to a reactivity of 25-50% and less than 25% reactivity is indicated by a blank square. Remarkably, multivalent constructs showed improved binding compared to their monovalent counterpart, to the mutant virus R7C2/11. In addition the biparatopic construct RSV403 was not sensitive to any of the mutants.

Example 29

Intranasal Delivery of Bivalent NANOBODY® ($V_{HH}$ Sequence) RSV101

To test the capacity of NANOBODY® ($V_{HH}$ sequence) RSV101 (SEQ ID NO: 2382) to neutralize virus in vivo, a mouse model was used. In this model, female Balb/c mice (9-10 weeks old) were inoculated intranasally with 100 μg of purified RSV101 dissolved in 50 μl PBS. As an irrelevant NANOBODY® ($V_{HH}$ sequence) control, the bivalent NANOBODY® ($V_{HH}$ sequence) 12D2biv was used. In addition, one group of mice received 100 μg Palivizumab (Synagis®) and a fourth group received PBS only. Five hours later, $10^6$ infectious units of the RSV A2 strain were administered intranasally. Four days and 1 day before virus infection and 1 and 4 days after infection mice were treated with cyclophosphamide (first dosing at 3 mg/kg; subsequent dosing at 2 mg/kg all administered s.c.) to suppress the immune system and as such to increase virus replication.

Three and 5 days after viral challenge, mice were killed; lungs were removed, homogenized and cleared from tissue by centrifugation. Sub-confluent Hep-2 cells, incubated in serum-free medium, were infected with serial dilutions of cleared lung homogenates. Four hours after infection the medium was removed and replaced by fresh medium containing 1% FCS and 0.5% agarose. Two to three days after infection the agarose overlay was removed to allow staining of RSV-plaques by an anti-RSV antibody.

Figure 24:
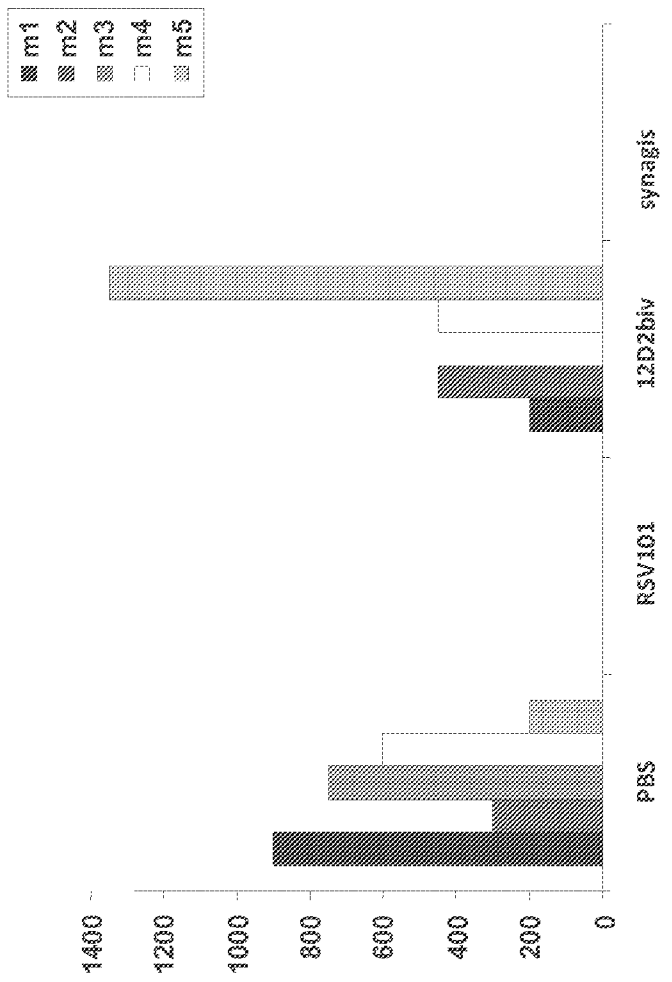
FIG. 24: Neutralization of virus in vivo by NANOBODY® ($V_{HH}$ sequence) RSV101. Bivalent NANOBODY® ($V_{HH}$ sequence) 191-D3 (RSV101), bivalent NANOBODY® ($V_{HH}$ sequence) 12D2biv, palivisumab and PBS only were inoculated intranasally into mice and 4 hours later challenged with RSV A2 strain as described in Example 29. Infectious virus (pfu/lung) present in lung homogenates 3 (FIG. 24A) and 5 (FIG. 24B) days after viral challenge and the mean (FIG. 24C) infectious virus (pfu/lung) for the 5 mice are given.
Figure 24:
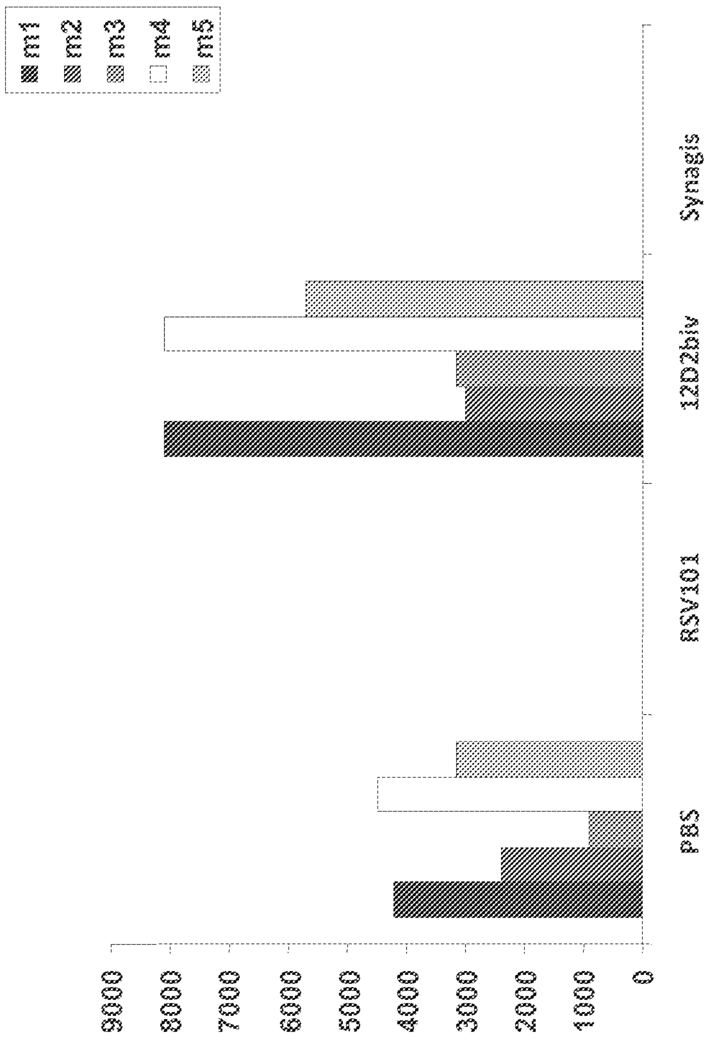
Figure 24:
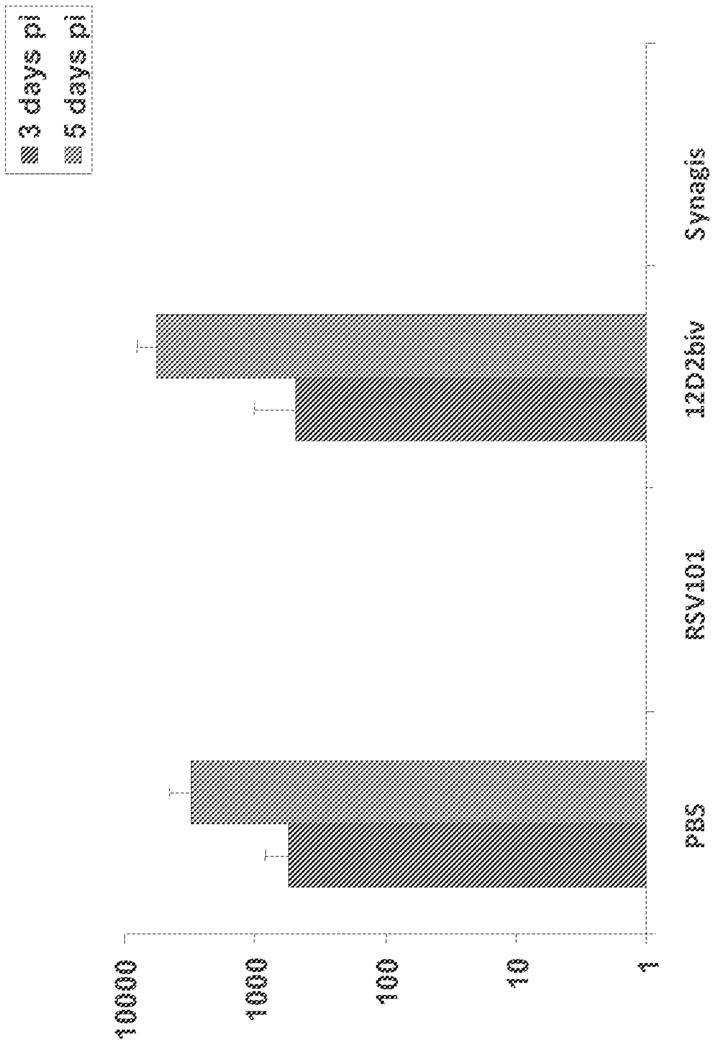

Infectious virus (pfu/lung) was recovered from all animals in the negative control groups (PBS and 12D2biv) in lung homogenates on day 3 (FIG. 24A) and 5 (FIG. 24B) after challenge. In FIG. 24C, the mean of infectious virus titers (pfu/lung) is represented. None of the animals in the RSV 101 and Synagis-treated group had detectable infectious virus on day 3 and 5 post challenge. Intranasal delivery of bivalent NANOBODY® ($V_{HH}$ sequence) RSV101 protected against infection and replication of RSV strain A2 in mice.

Example 30

Functionality of NANOBODY® ($V_{HH}$ Sequence) RSV101 after Intranasal Administration In order to test whether NANOBODIES® ($V_{HH}$ sequences) or palivizumab antibodies might still be present in lungs 3 and 5 days after inoculation, lung homogenates of PBS treated mice were pre-incubated for 1 h with the same volume of lung homogenates from the different experimental groups described in Example 29, prepared either three or five days post-infection.

Figure 25:
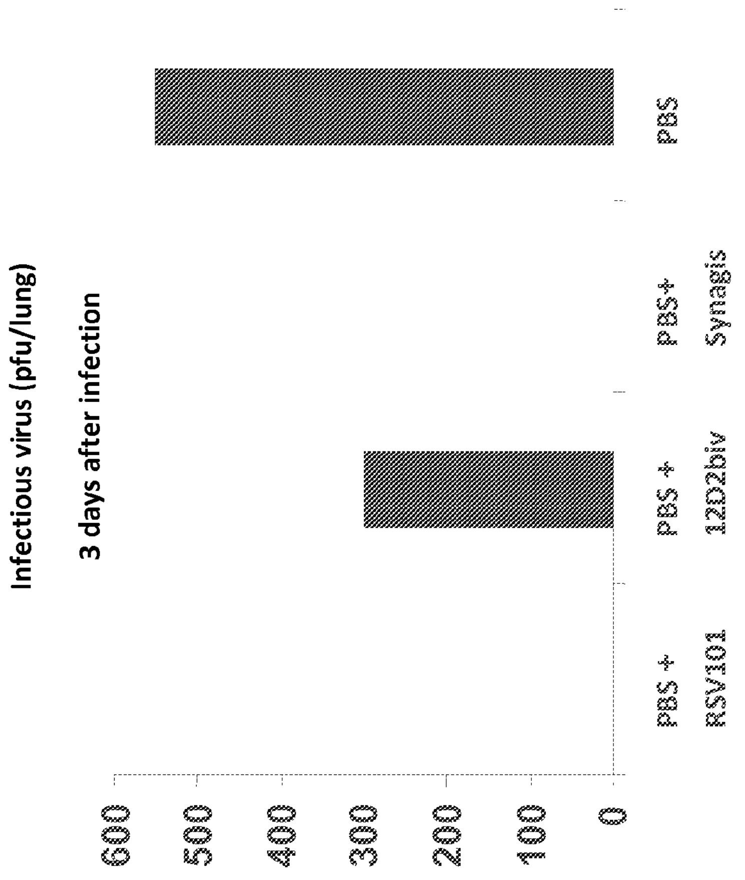
FIG. 25: Presence of NANOBODY® ($V_{HH}$ sequence) RSV101 3 (FIG. 25A) and 5 (FIG. 25B) days following intranasal inoculation in mice. Lung homogenates of PBS treated mice were pre-incubated with lung homogenate from RSV101 treated mice, 12D2biv treated mice and palivisumab treated mice as described in Example 30.
Figure 25:
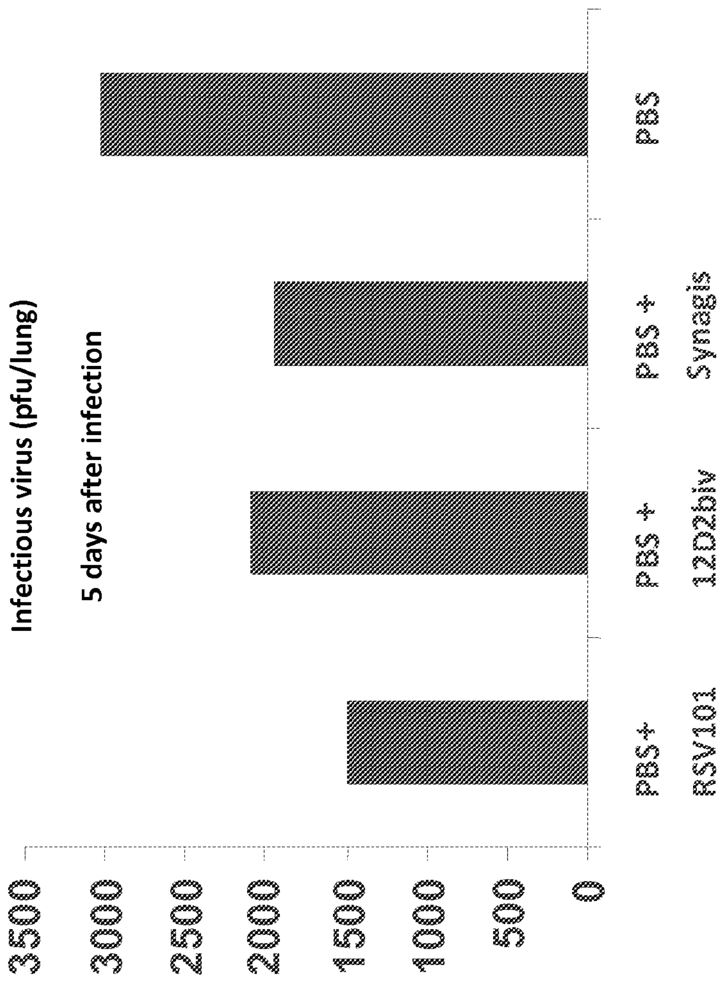

As shown in FIG. 25A, incubation of lung homogenates from PBS treated mice with lung homogenates prepared three days after infection from either RSV101 or palivizumab but not 12D2biv treated mice neutralized the virus present in the lung homogenates from PBS treated mice. In contrast, none of the lung homogenates of mice treated with RSV101 or Synagis prepared five days after infection could severely neutralize the virus present in the lung homogenates of PBS treated mice (FIG. 25B).

Taken together, these data show that the functional bivalent NANOBODY® ($V_{HH}$ sequence) RSV 101 remains present and functionally active in the lungs for at least 72 hours after administration.

Figure 54:
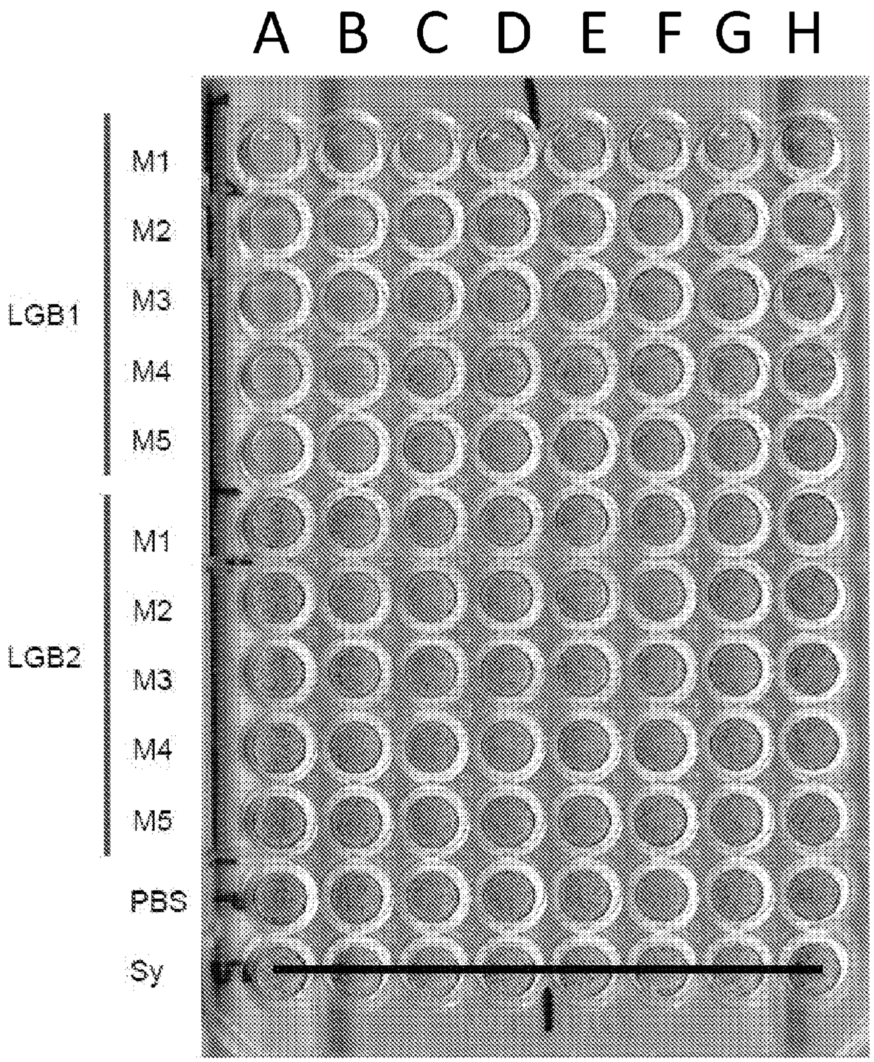
FIG. 54: Demonstration of presence of functional virus-neutralizing NANOBODIES® ($V_{HH}$ sequences) in the lung homogenates of mice as described in Example 30. A: 8 μl lung homogenate; B: 2 μl lung homogenate; C: 0.5 μl lung homogenate; D: 0.125 μl lung homogenate; E: 0.03125 μl lung homogenate; F: 0.0078 μl lung homogenate; G: 0.00019 lung homogenate; H: 0 μl lung homogenate (dilution in PBS). LGB1 is the RSV101 NANOBODY® ($V_{HH}$ sequence) construct. LGB2 is the 12B2biv control NANOBODY® ($V_{HH}$ sequence) construct.
Figure 55A:
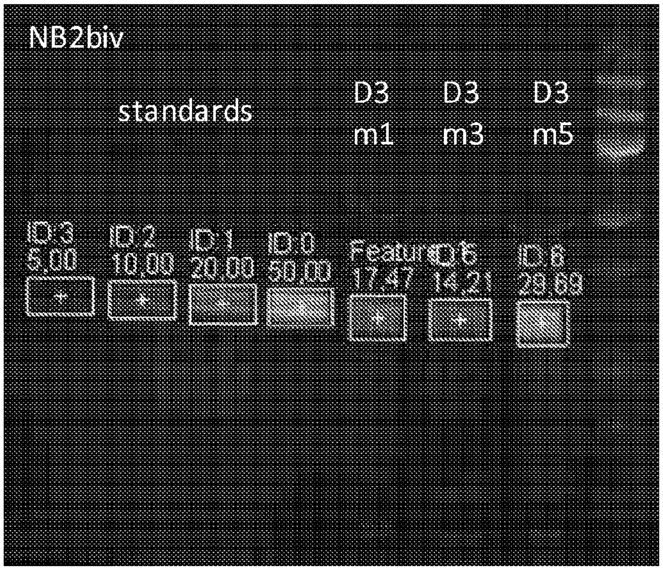
FIG. 55: Western blots of lung homogenates of mice inoculated with NANOBODY® ($V_{HH}$ sequence) RSV101 (A-C) or 12B2biv (D-E). The Western blots were scanned with an Odyssey Infrared Imaging system (Licor Biosciences) and the analyses (determinations of concentrations) were done with the Odyssey v3.0 software. Standards: 50 ng, 20 ng, 10 ng and 5 ng of the same NANOBODY® ($V_{HH}$ sequence) in homogenization buffer; D3: three days after infection; D5: five days after infection; m1-m5: mouse 1-5.
Figure 55B:
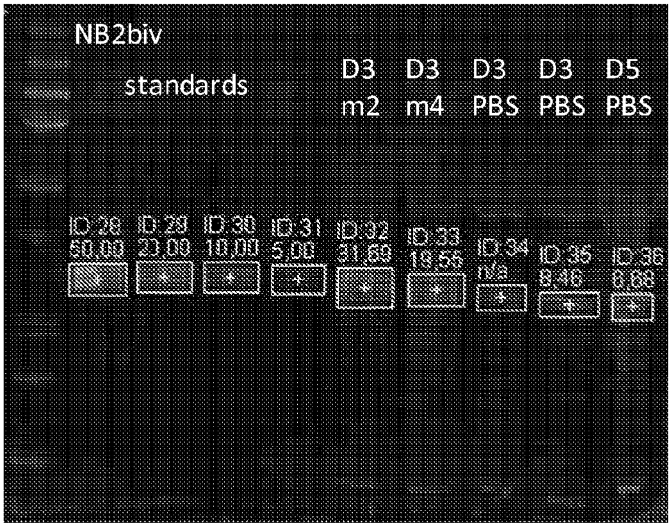
Figure 55C:
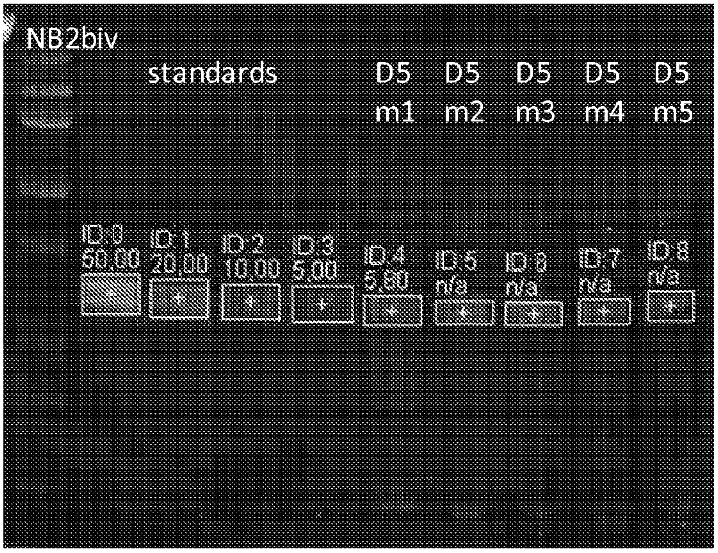
Figure 55D:
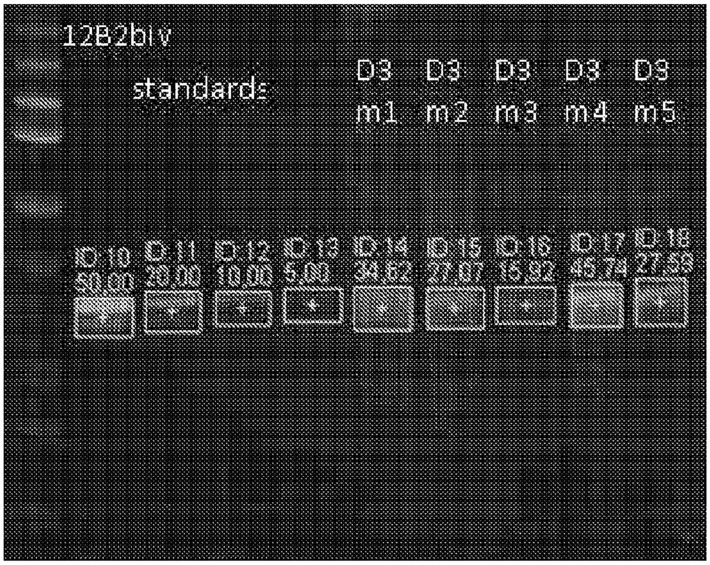
Figure 55E:
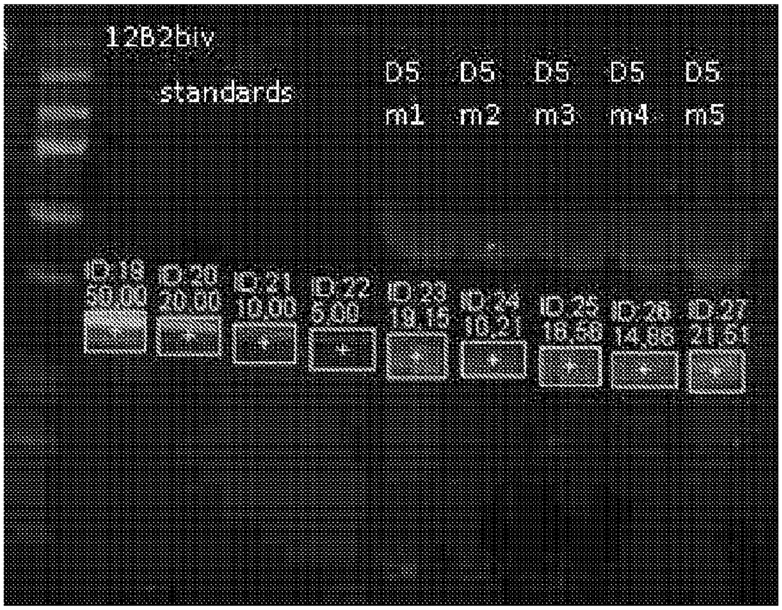

To further demonstrate the presence of functional virus-neutralizing NANOBODIES® ($V_{HH}$ sequences) in the lung homogenates, 500 plaque forming units (pfu) of RSV were incubated with different amounts of lung homogenates. These mixtures were incubated for 90 minutes at room temperature. Next, mixtures were put on HepG2 cells grown in 96 well plates. After 2 hours cells were washed and an overlay of growth medium with 0.5% agarose was added. After three days RSV plaques were visualized (FIG. 54). From the data (FIG. 54) it is clear that lunghomogenates from all 5 mice that received RSV101 NANOBODY® ($V_{HH}$ sequence) three days before mice were killed, neutralized the 500 pfu of RSV when 8 and 2 µl of homogenates were used. This was not observed using lung homogenates form contole NANOBODY® ($V_{HH}$ sequence) (12B2biv) treated mice.

Example 31

Viral RNA is not Detected in the Lungs of Mice Pre-Treated Intranasally with RSV101

The results described in Example 29 demonstrated that no infectious virus was present in the lungs of mice treated with RSV 101. However, there was still the possibility that virus had infected cells and that viral genomic RNA was replicated with release of non-infectious viral particles or without release of viral particles. To investigate this possibility, the presence of viral RNA was determined by qPCR. RNA was isolated from 100 µl of each long homogenate (1000 µl) prepared 5 days post-infection. By the use of an M-gene specific primer RSV genomic RNA specific cDNA was synthesized and quantified by qPCR (in duplicate). The level of viral genomic RNA in each lung homogenate was calculated relative to a lung sample which showed the lowest qRT-PCR signal (normalized to value of 1). As shown in Table C-9, the presence of relative viral genomic RNA in lungs of mice treated with RSV101 and Synagis® was reduced strongly compared to PBS or 12D2biv treated mice.

Example 32

The HA-Pseudotyped Neutralization Assay

A HA pseudotyped neutralization assay was developed as described in Temperton et al. 2007 (Temperton N J, Hoschler K, Major D et al. A sensitive retroviral pseudotype assay for influenza H5N1-neutralizing antibodies. Influenza and Other Respiratory Viruses 2007 1: 105-112). The construction of HA pseudotyped viruses and assays was also done according to Temperton et al. 2007.

Plasmids and Cell Lines

Plasmid pI.18/VN1194 HA was constructed at NIBSC (Hertfordshire, UK). The full-length HA ORF from A/Vietnam/1194/04 was amplified by PCR and cloned into the expression vector pI.18. This backbone plasmid is a pUC-based plasmid incorporating promoter and Intron A elements from human cytomegalovirus.

The MLV and HIV gag/pol constructs have been described previously (Besnier C, Takeuchi Y, Towers G. 2002, Restriction of lentivirus in monkeys. Proc. Natl. Acad. Sci. USA 9: 11920-11925) The luciferase (Luc) reporter construct MLV-Luc has been described in Op De Beeck A, Voisset C, Bartosch B et al. 2004 (Characterization of functional hepatitis C virus envelope glycoproteins. J. Virol. 78: 2994-3002). Vesicular stomatitis virus envelope protein (VSV-G) expression vector pMDG has been described previously (Naldini L, Blomer U, Gallay P et al. 1996, In vivo gene delivery and stable transduction of nondividing cells by a lentiviral vector. Science 272: 263-267). All cell lines were cultured in Dulbecco's modified eagle medium (DMEM) with Glutamax and high glucose (Gibco, Paisley, Scotland, UK), supplemented with 10% fetal calf serum and penicillin/streptomycin, except for HEK 293T cells (15% fetal calf serum).

Viral Vector Production and Infection of Target Cells

Confluent plates of 293T cells were split 1:4 the day before transfection. Each plate of 293T cells was transfected with 1 µg gag/pol construct, 1.5 g Luc reporter construct, and 1.5 g HA- or VSV-G-expressing construct by using the Fugene-6 transfection reagent. At 24 h post-transfection, 1 U of exogenous neuraminidase (Sigma, St. Louis, Mo., USA) was added to induce the release of HA-pseudotyped particles from the surface of the producer cells. Supernatant was harvested 48 and 72 h post-transfection, filtered through 0.45-lm filters, and stored at −80° C. MLV vector titers were measured on human 293T, quail QT6, canine MDCK, porcine PK15 and ST-IOWA cells and are presented as infectious units (IU) per milliliter. Briefly, cells were infected with vector, and Luc titers were determined 72 h later by Luc assay. Titers were expressed as RLU for Luc.

MLV(HA) Pseudotype Neutralization Assay

Serum samples (5 n1) were heat inactivated at 56° C. for 30 min, twofold serially diluted in culture medium, and mixed with MLV(HA) virions (10 000 RLU for Luc) at a 1:1 v/v ratio. Purified NANOBODIES® ($V_{HH}$ sequences) (10 or 20 n1) were diluted to 100 n1 and twofold serially diluted in culture medium, and mixed with MLV(HA) virions (10 000 RLU for Luc) at a 1:1 v/v ratio. After incubation at 37° C. for 1 h, $1\times10^4$ 293T cells were added to each well of a 96-well flat-bottomed plate. Relative light units (RLU) for Luc were evaluated 48 h later by luminometry using the Promega Bright-Glo system (Promega, Madison, Wis., USA) according to the manufacturer's instructions. IC90/IC50-neutralizing antibody titers were determined as the highest serum dilution resulting in a 90/50% reduction of infection (as measured by marker gene transfer) compared with a pseudotype virus only control. For Luc, titers <100 are designated negative.

Example 33

Figure 26:
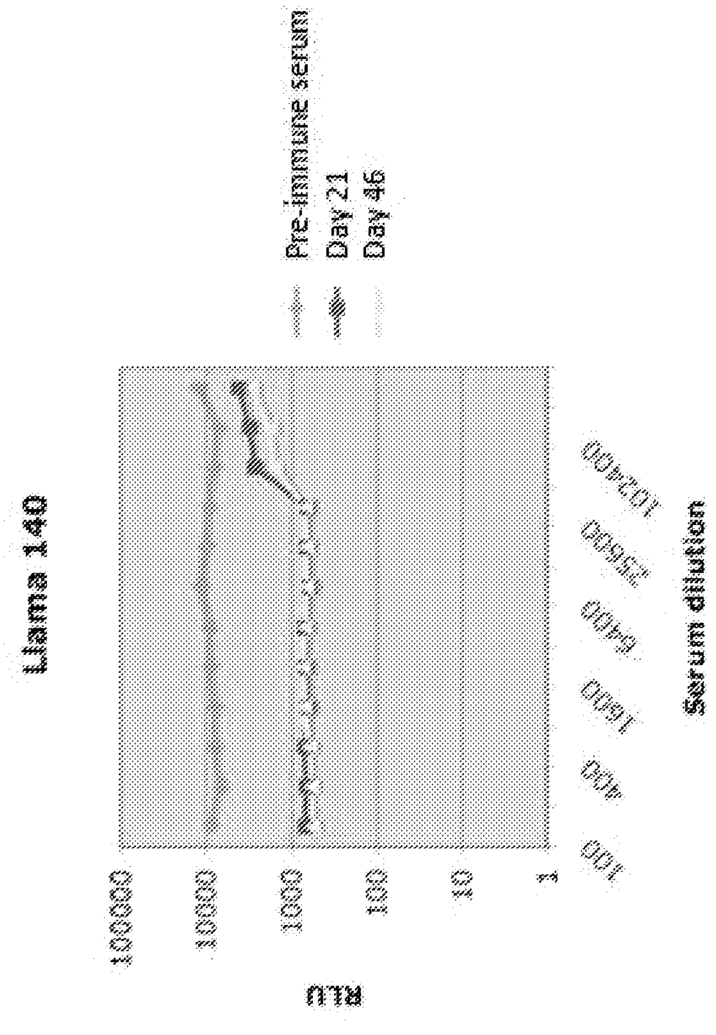
FIGS. 26A and B: Virus neutralizing titers of llama serum after immunization with hemaglutinin as described in Example 33.
Figure 26:
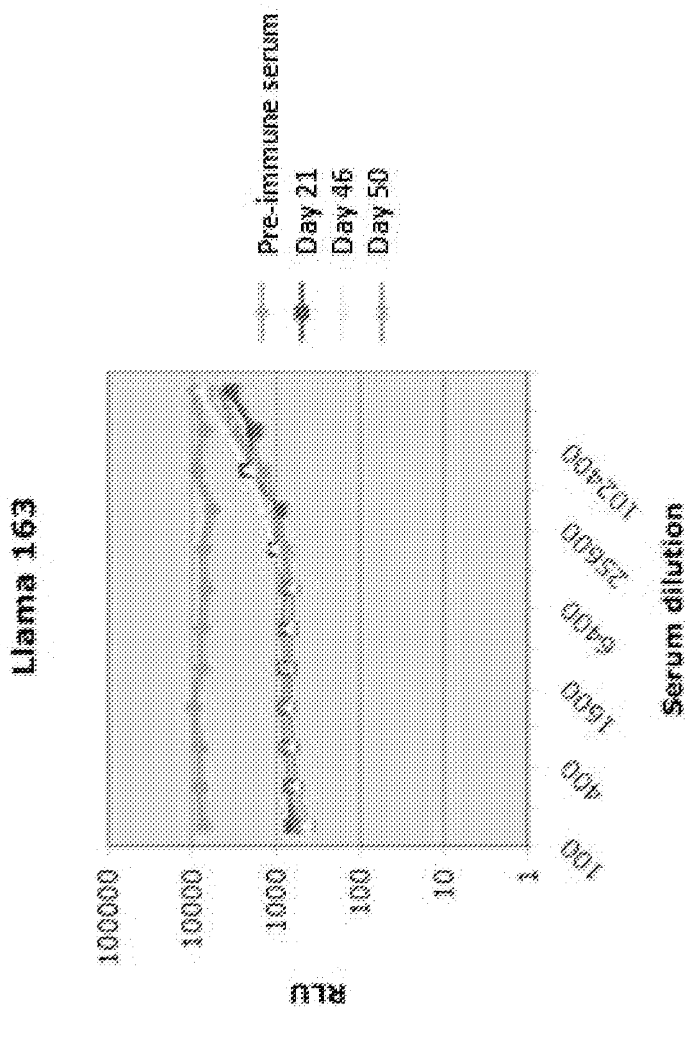

Llamas Develop High Virus-Neutralizing Antibody Titers after Immunizations with Purified H5 HA Sera taken from immunized llamas before (pre-immune) and 21 and 48 days after the first immunization was tested in the pseudotyped neutralization assay as described in Example 32 (FIG. 26). Pre-immune serum showed no neutralizing activity, while IC90s of 25600 to 51200 were present in llama 140 and 163, respectively.

Example 34

Figure 28:
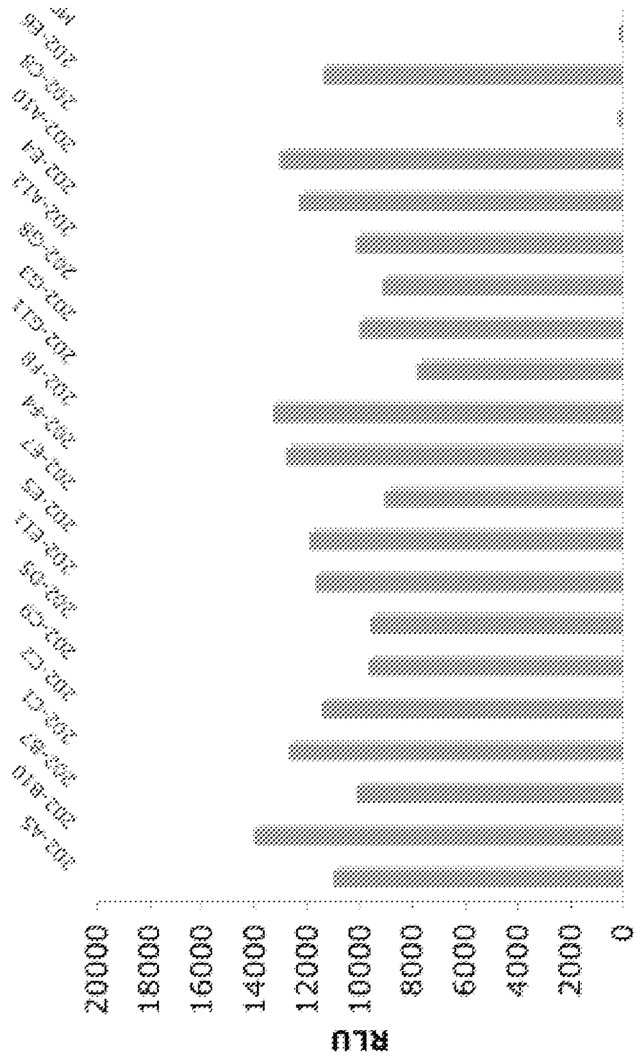
FIG. 28: Neutralization of HA pseudotyped virus by a single 10 fold dilution of different NANOBODIES® ($V_{HH}$ sequences) as described in Example 34.
Figure 29:
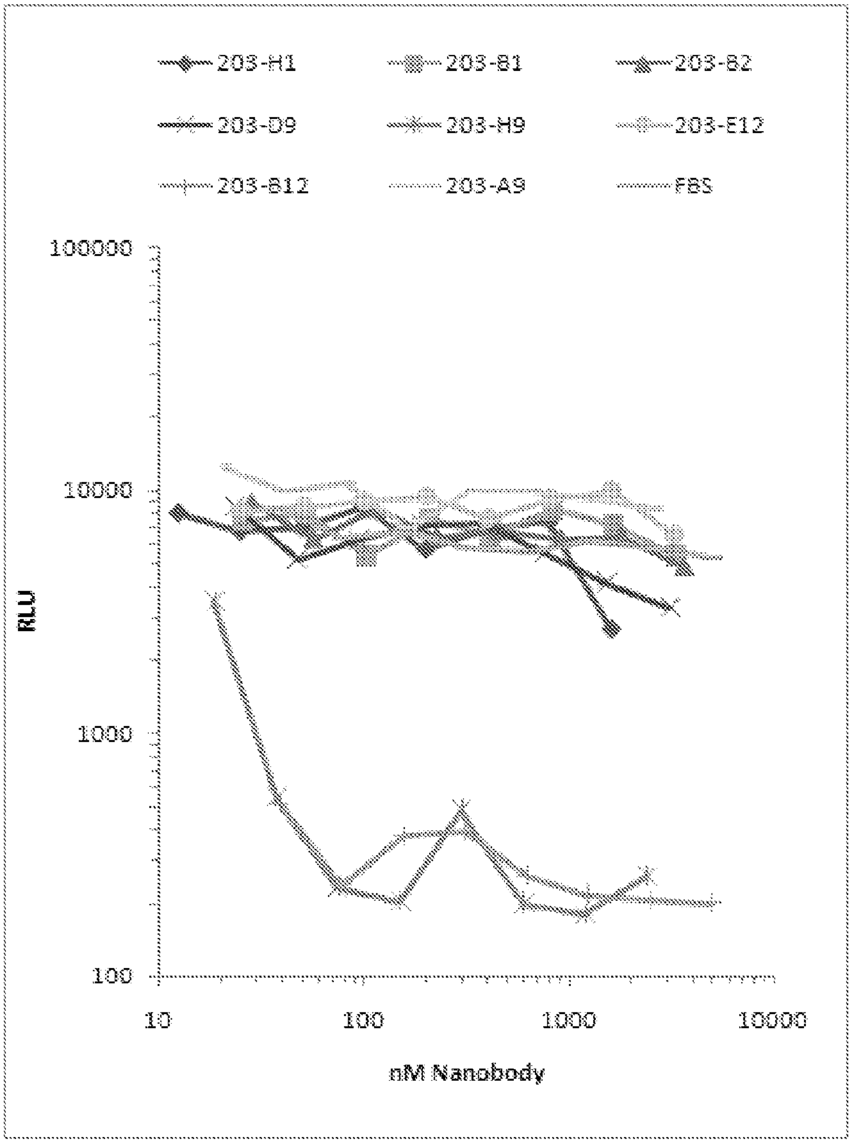
FIG. 29: Neutralization of HA pseudotyped virus by NANOBODY® ($V_{HH}$ sequence) 203-B12 and 203-H9 as described in Example 34.

Identification of NANOBODIES® ($V_{HH}$ Sequences) that Neutralize HA Pseudotyped Virus Several purified NANOBODIES® ($V_{HH}$ sequences) were tested in the pseudo typed virus neutralization assay described in Example 32. In FIG. 28, the neutralization of a single 10 fold dilution of different NANOBODIES® ($V_{HH}$ sequences) (202-A5; SEQ ID NO: 128, 202-B10; SEQ ID NO: 130, 202-B7; SEQ ID NO: 131, 202-C1; SEQ ID NO:134, 202-C2; SEQ ID NO: 136, 202-C9; SEQ ID NO: 139, 202-D5; SEQ ID NO: 140, 202-E11; SEQ ID NO: 143, 202-E5; SEQ ID NO: 145, 202-E7; SEQ ID NO: 147, 202-F4; SEQ ID NO: 151, 202-F8; SEQ ID NO: 152, 202-G11; SEQ ID NO: 153, 202-G3; SEQ ID NO: 154, 202-G8; SEQ ID NO: 155, 202-A12; SEQ ID NO: 127, 202-E4; SEQ ID NO: 2447, 202-A10; SEQ ID NO: 126, 202-C8; SEQ ID NO: 138, 202-E6; SEQ ID NO: 146) is shown. Only NANOBODY® ($V_{HH}$ sequence) 202-C8 strongly reduced luciferase activity, indicative for a virus neutralizing activity of this NANOBODY® ($V_{HH}$ sequence). The identification of two more virus-neutralizing NANOBODIES® ($V_{HH}$ sequences) 203-B12 (SEQ ID NO: 2439) and 203-H9 (SEQ ID NO: 2445) is depicted in FIG. 29.

Example 35

Combinations of NANOBODIES® ($V_{HH}$ Sequences)

Figure 30:
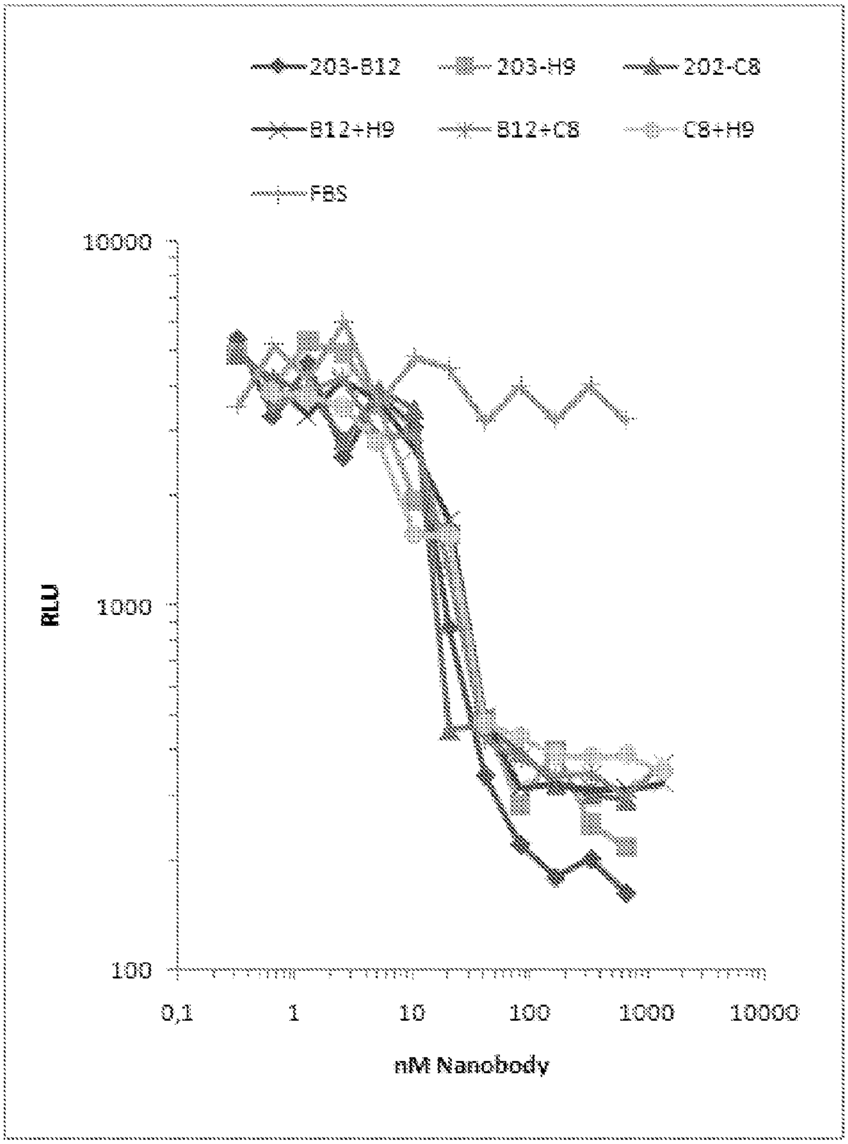
FIG. 30: Neutralization of HA pseudotyped virus by combinations of NANOBODIES® ($V_{HH}$ sequences) 202-C8, 203-H9 and 203-B12 as described in Example 35.

Combined treatment with different virus neutralizing antibodies might results in additive or even synergistic neutralizing effect (Zwick M B, Wang M, Poignard P, Stiegler G, Katinger H, et al. 2001, Neutralization synergy of human immunodeficiency virus type 1 primary isolates by cocktails of broadly neutralizing antibodies. J Virol, 75: 12198-12208; Laal S, Burda S, Gorny M K, Karwowska S, Buchbinder A et al. 1994, Synergistic neutralization of human immunodeficiency virus type 1 by combinations of human monoclonal antibodies. J. Virol. 68: 4001-4008; Li A, Baba T W, Sodroski J, Jolla-Pazner S, Gomy M K, et al. 1998, Synergistic neutralization of simian-human immunodeficiency virus SERV by triple and quadruple combinations of human monoclonal antibodies and high-titer anti-human immunodeficiency. J. Virol. 72: 3235-40). However, this was not observed when combinations of 202-C8 with 203-B12, 202-C8 with 203-H9 or 203-B12 with 203-H9 were tested in the pseudotyped neutralization assay (FIG. 30).

Example 36

Bi- and Trivalent NANOBODIES® ($V_{HH}$ Sequences)

Protocols are available for construction of a bivalent or trivalent NANOBODY® ($V_{HH}$ sequence) connected by Gly-Ser linker(s) of any desired length and composition. It is based on the separate PCR reactions (1 for the N-terminal, 1 for the middle (if trivalent) and 1 for the C-terminal VHH subunit) using different sets of primers. Different linker lengths can also be introduced by the primers.

Figure 31:
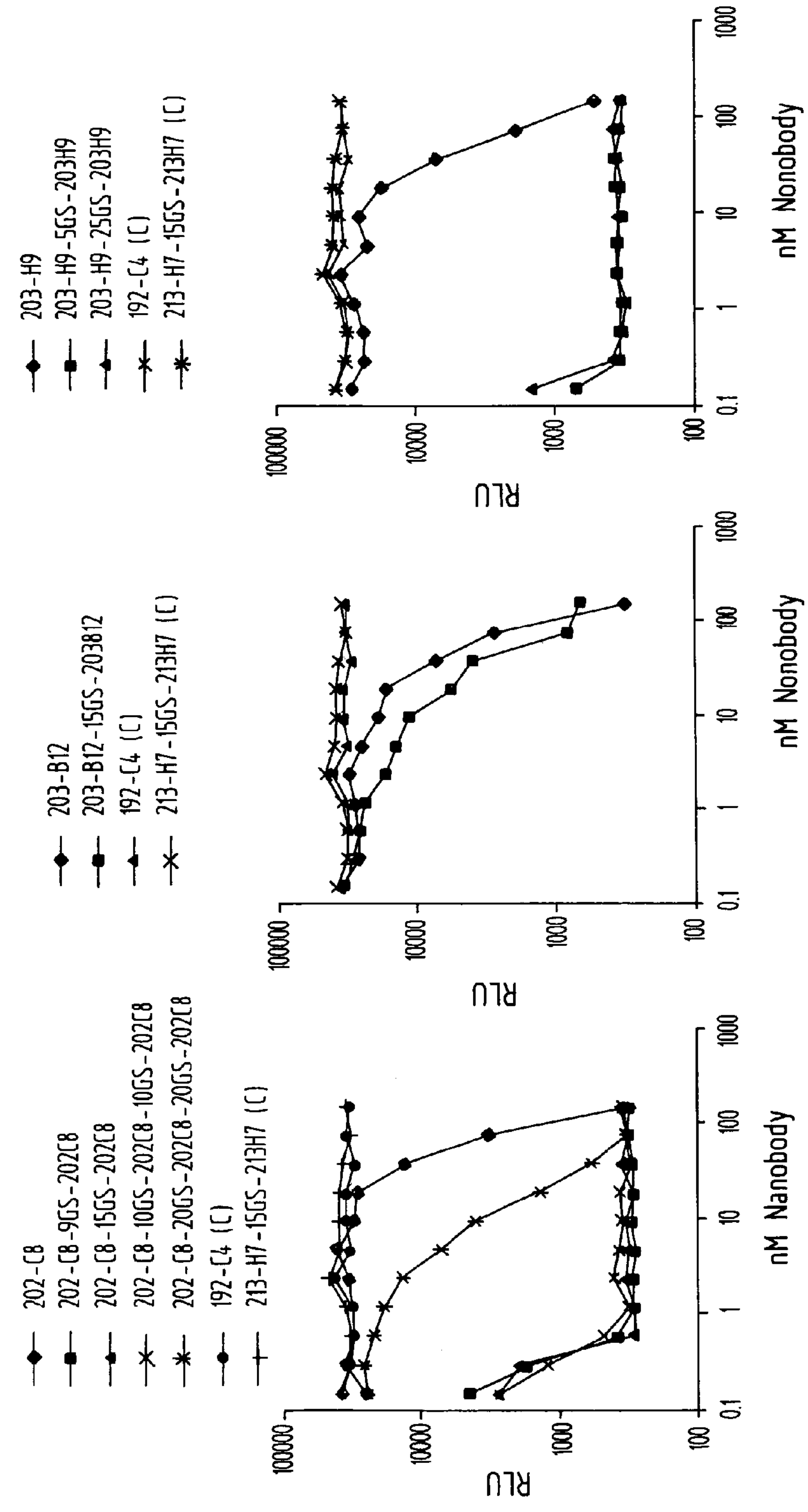
FIG. 31: Potency of monovalent, bivalent and trivalent NANOBODY® ($V_{HH}$ sequence) constructs to neutralize HA pseudotyped virus as described in Example 36.

Bivalent and trivalent NANOBODIES® ($V_{HH}$ sequences) with different linker lengths from 202-C8 and 203-B12 and 203-H9 were constructed (SEQ ID NO's: 2423 to 2430; Table A-4). When tested in the pseudotyped neutralization assays all bivalent and trivalent NANOBODIES® ($V_{HH}$ sequences) showed superior neutralization potencies compared to the monovalent building blocs. (FIG. 31).

To test the potency of different NANOBODY® ($V_{HH}$ sequence) formats against different H5 strain viruses, lentiviral pseudotyped viruses were used. For transfection, $5\times10^6$ HEK-293T cells were plated 24 h prior to addition of a complex comprising plasmid DNA and Fugene 6™ that facilitated DNA transport into the cells (as described by the manufacturer; Roche, UK). The human immunodeficiency virus type 1 (HIV-1) gag-pol construct pCMV-A8.91 and firefly luciferase reporter construct (pCSLW, where the luciferase gene has been cloned into pCSGW in place of GFP) were transfected concurrently with the required H5 HA envelope construct (pI.18-H5HA from different H5 clades) at a μg ratio of 1:1.5:1 respectively. 24 hours post-transfection, 1 U exogenous bacterial NA was added to each plate to effect particle release into the supernatant. At 48 and 72 hrs post-transfection, virus was harvested by filtration through a 0.45 uM filter and stored at −80 C until needed. Neutralization assays were performed very similar to the previously described MLV (HA) assays (Example 32).

Figure 57A:
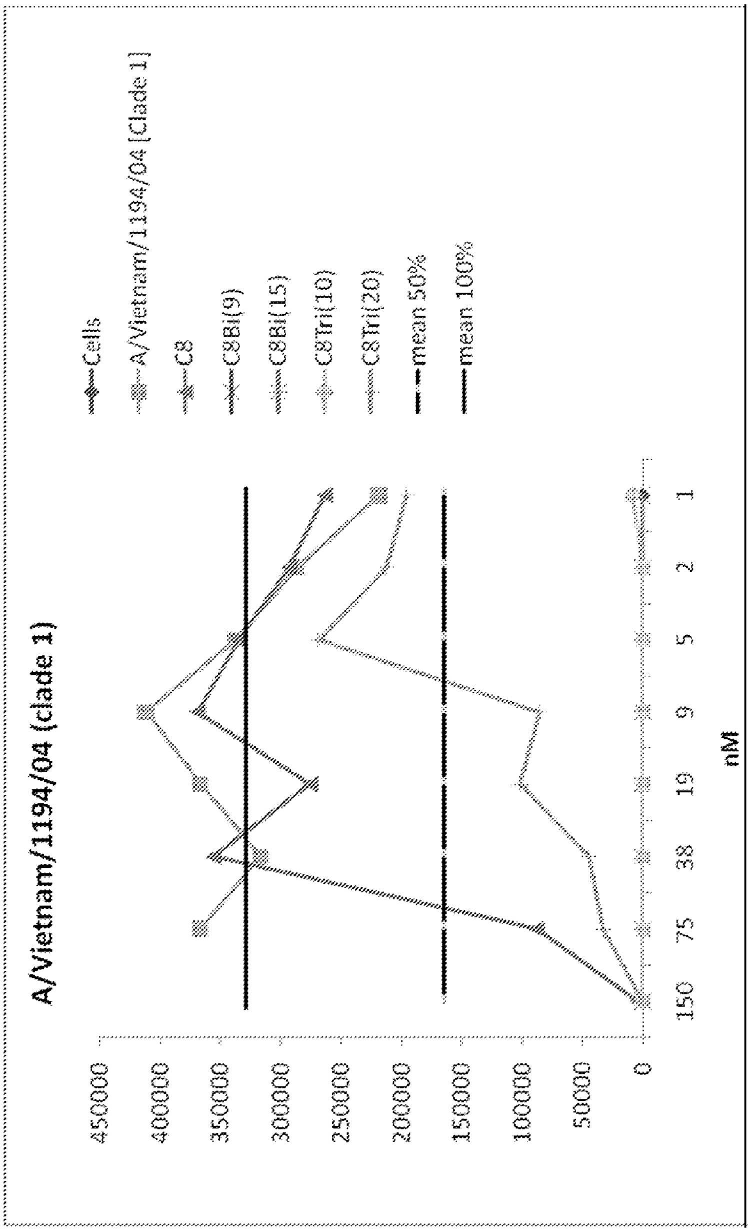
FIG. 57A-K: Neutralization of different H5 variants by different multivalent constructs of NANOBODY® ($V_{HH}$ sequence) 202-C8, tested in the lentiviral pseudotyped neutralization assay as described in Example 36. C8 refers to NANOBODY® ($V_{HH}$ sequence) 202-C8; C8Bi(9) refers to the bivalent 202-C8 NANOBODY® ($V_{HH}$ sequence) with a 9GS linker (SEQ ID NO: 2423); C8Bi(15) refers to the bivalent 202-C8 NANOBODY® ($V_{HH}$ sequence) with a 15GS linker (SEQ ID NO: 2424); C8Tri(10) refers to the trivalent 202-C8 NANOBODY® ($V_{HH}$ sequence) with a 10GS linker (SEQ ID NO: 2425); C8Tri(20) refers to the trivalent 202-C8 NANOBODY® ($V_{HH}$ sequence) with a 20GS linker (SEQ ID NO: 2426).
Figure 57B:
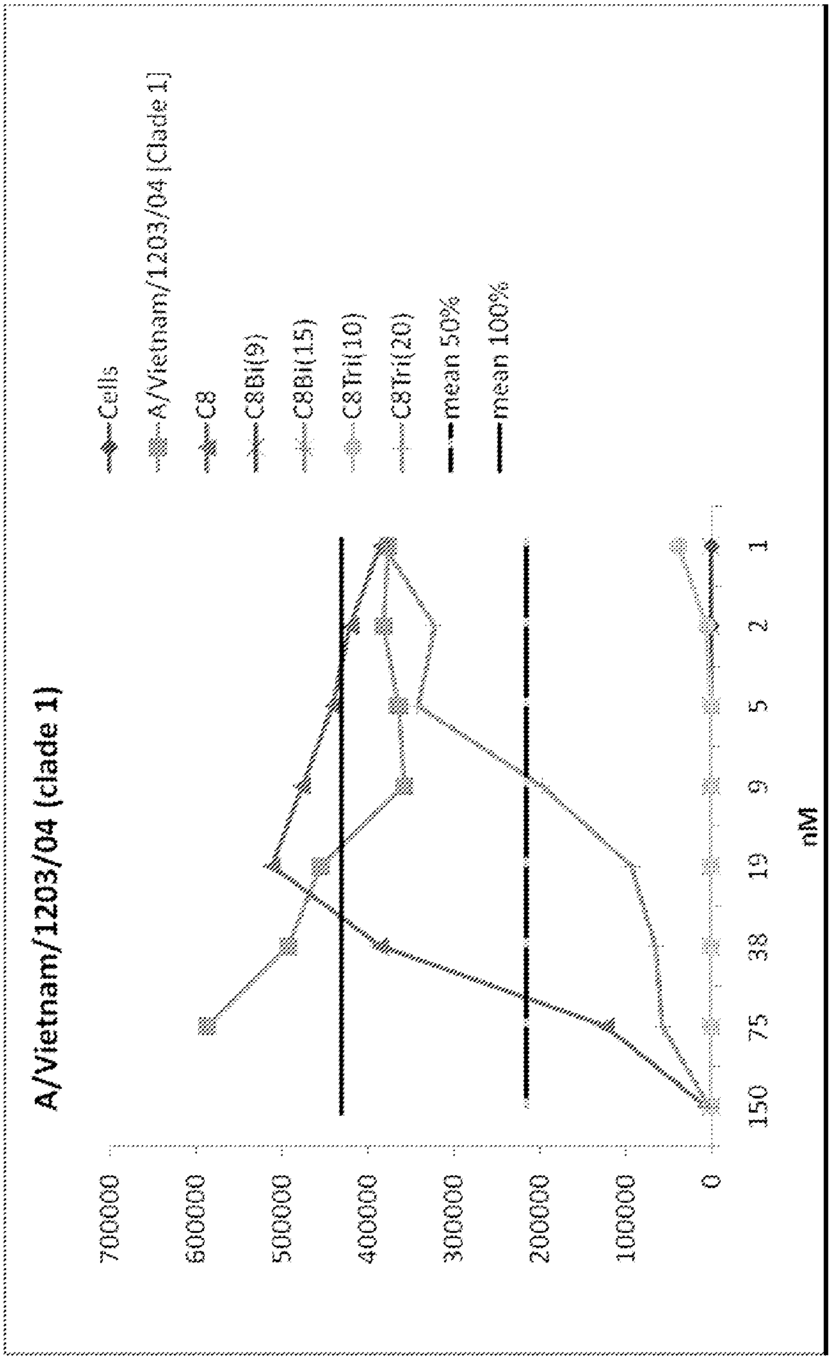
Figure 57:
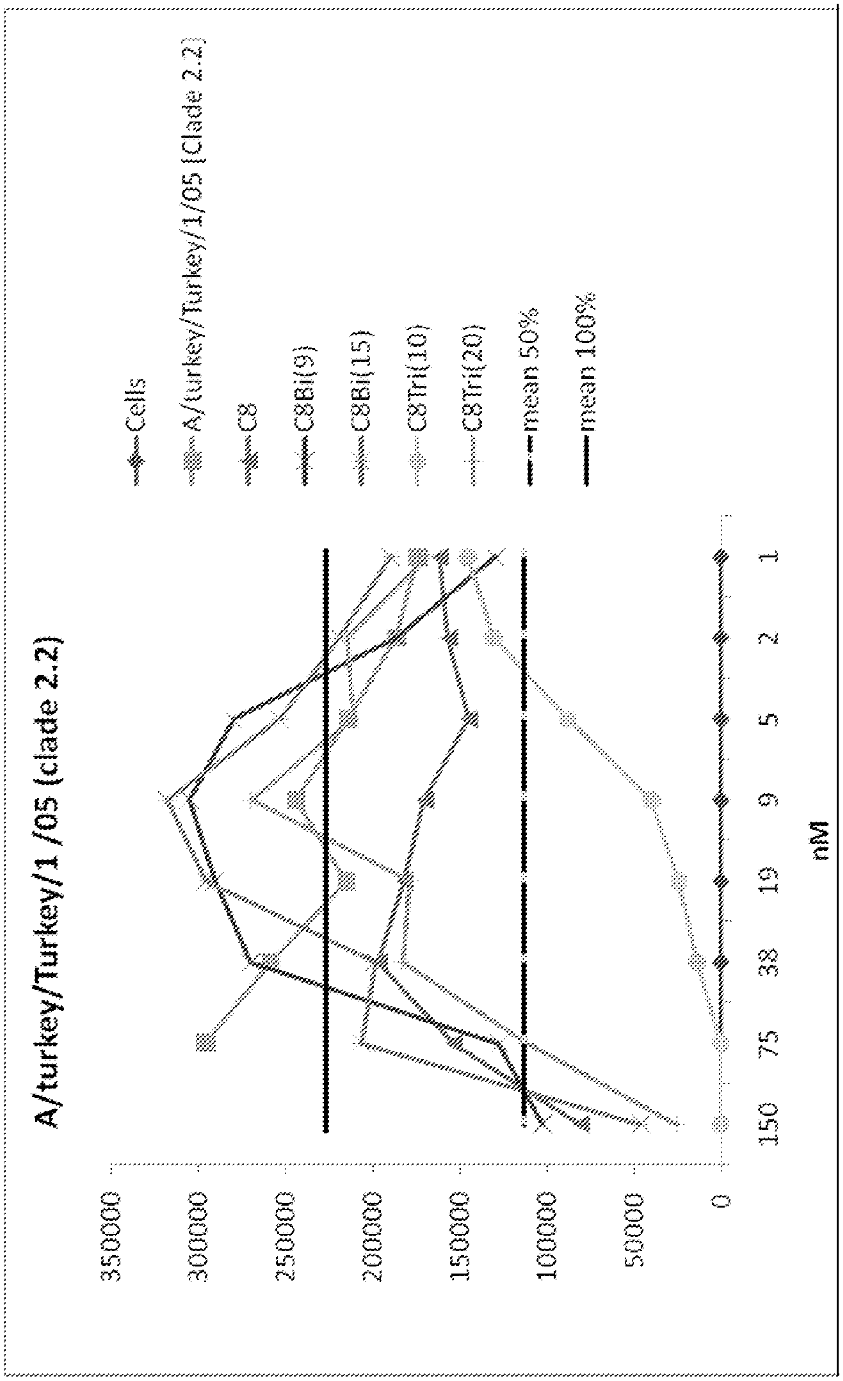
Figure 57:
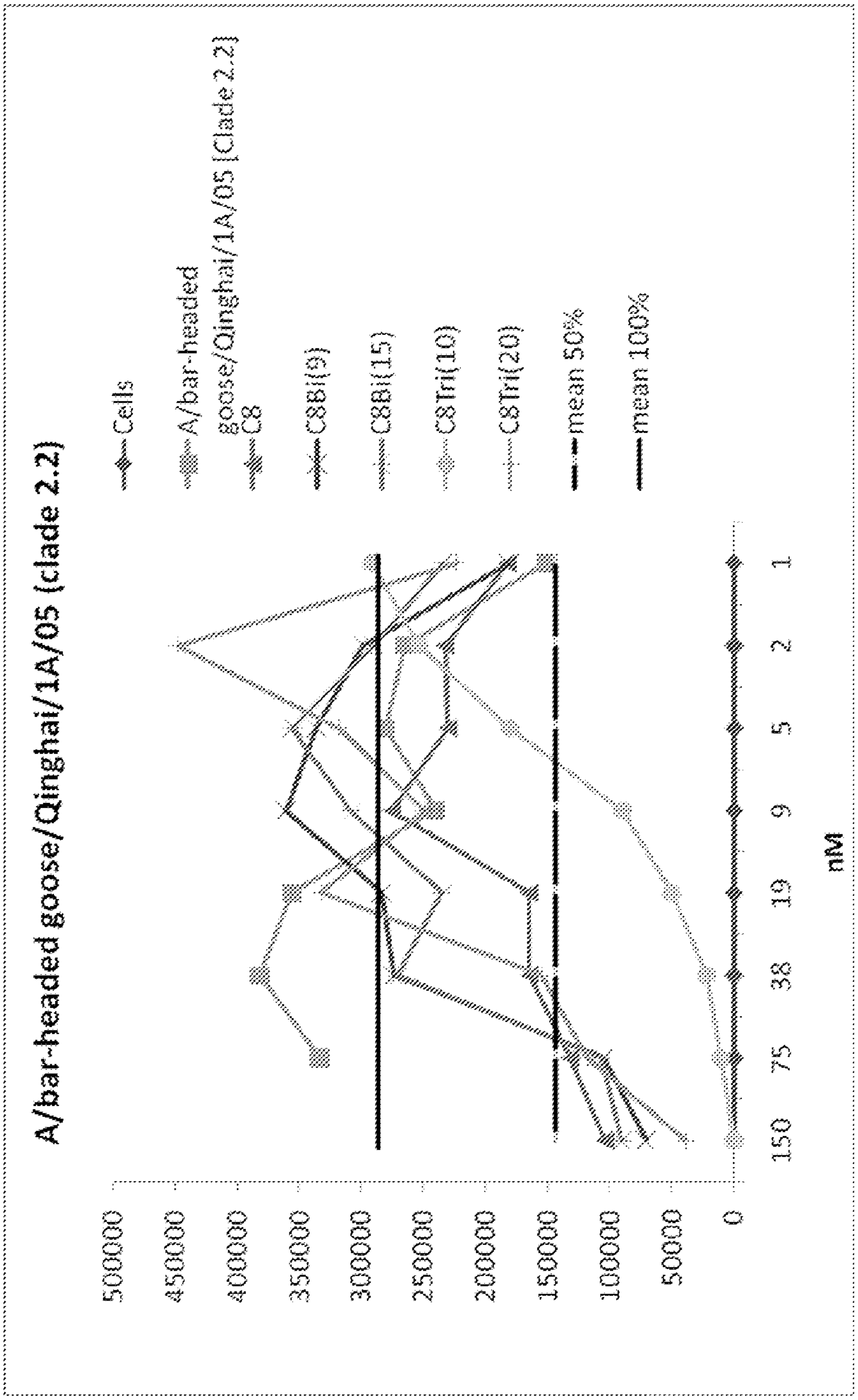
Figure 57:
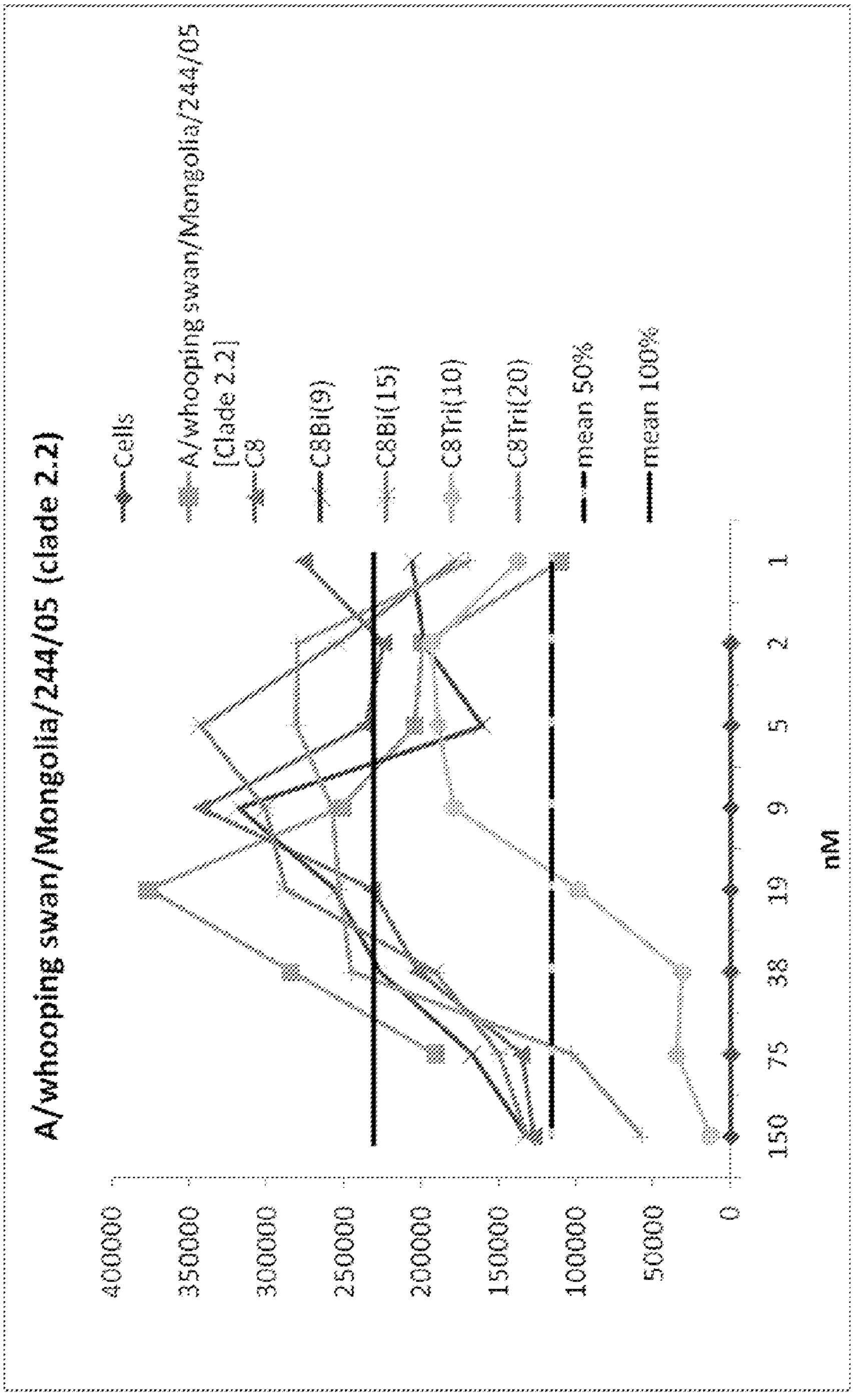
Figure 57:
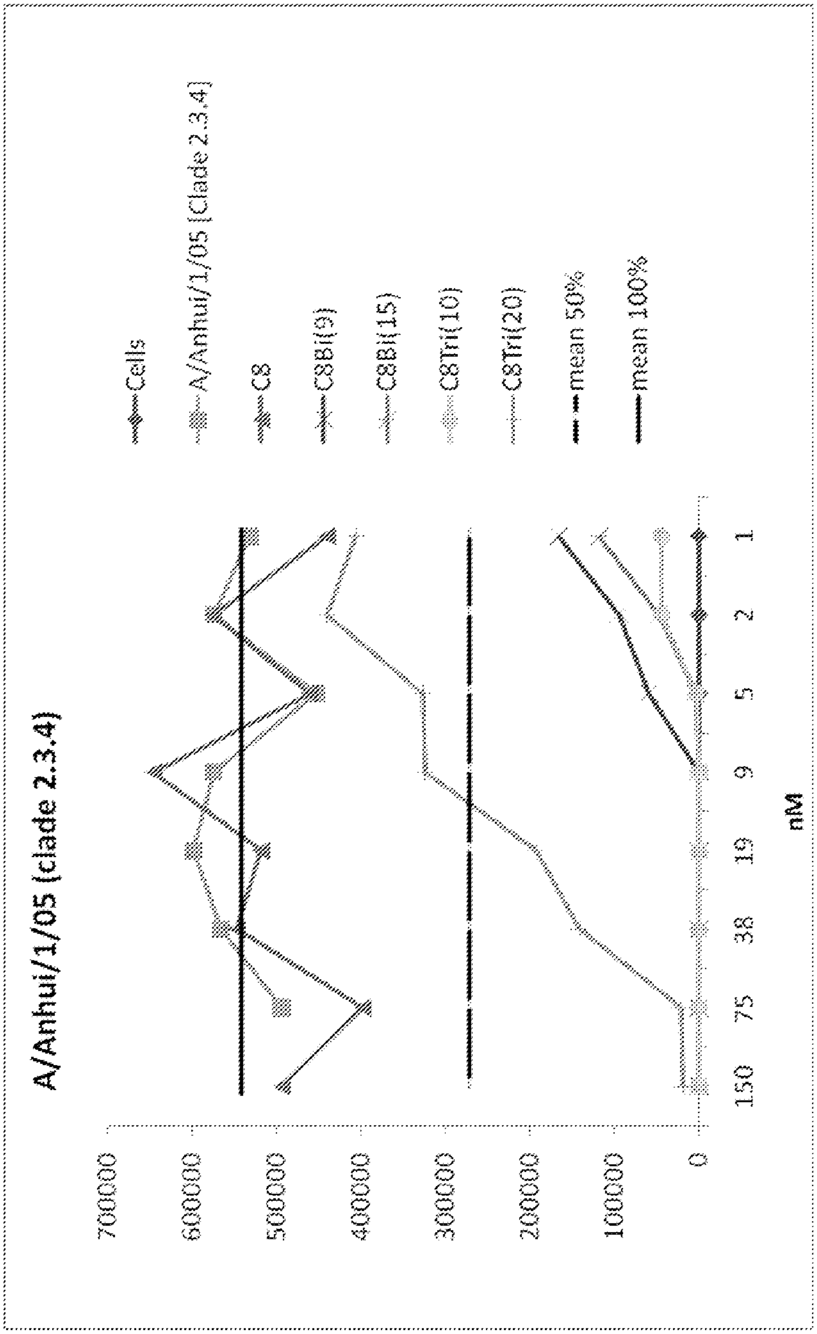
Figure 57:
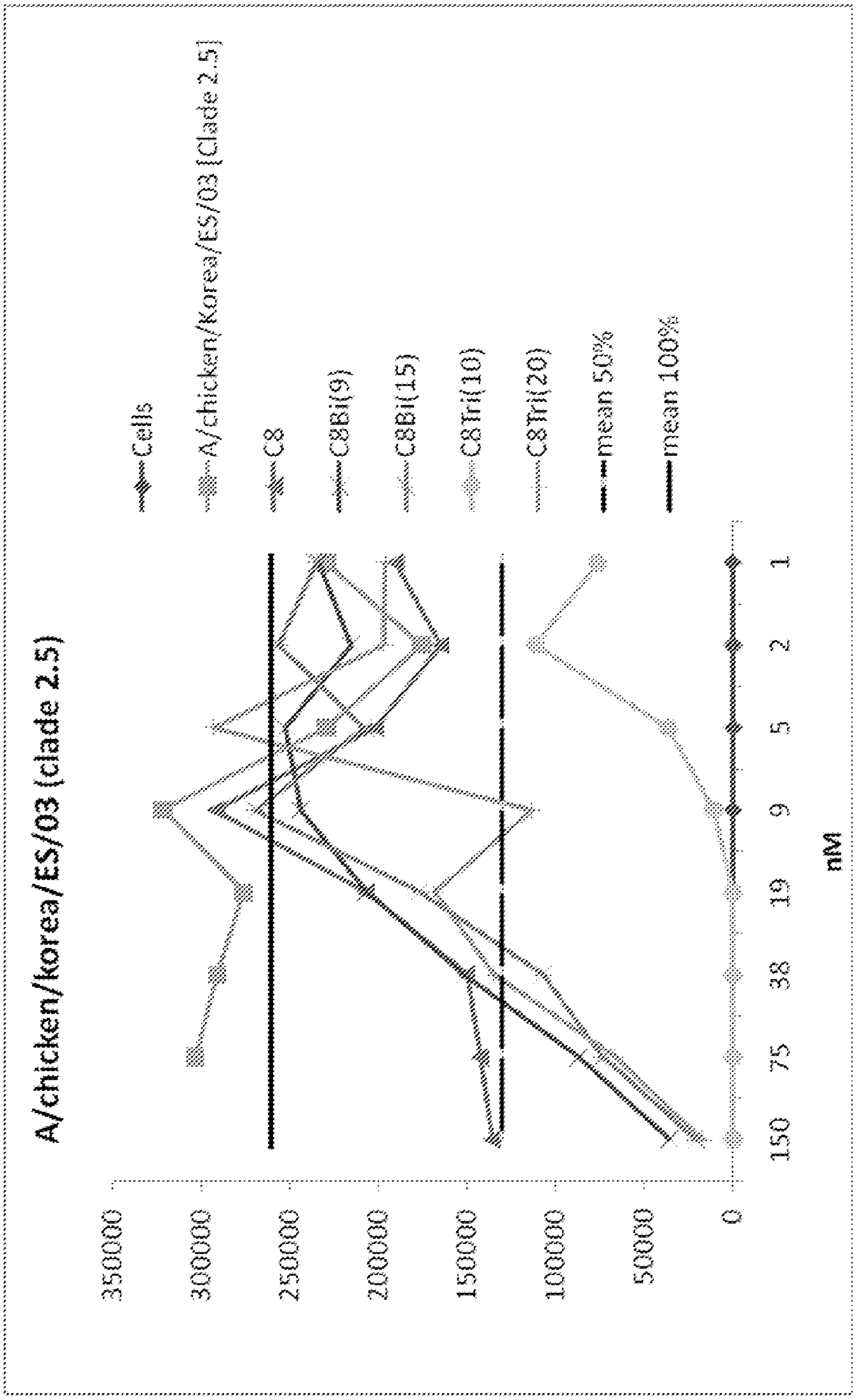
Figure 57:
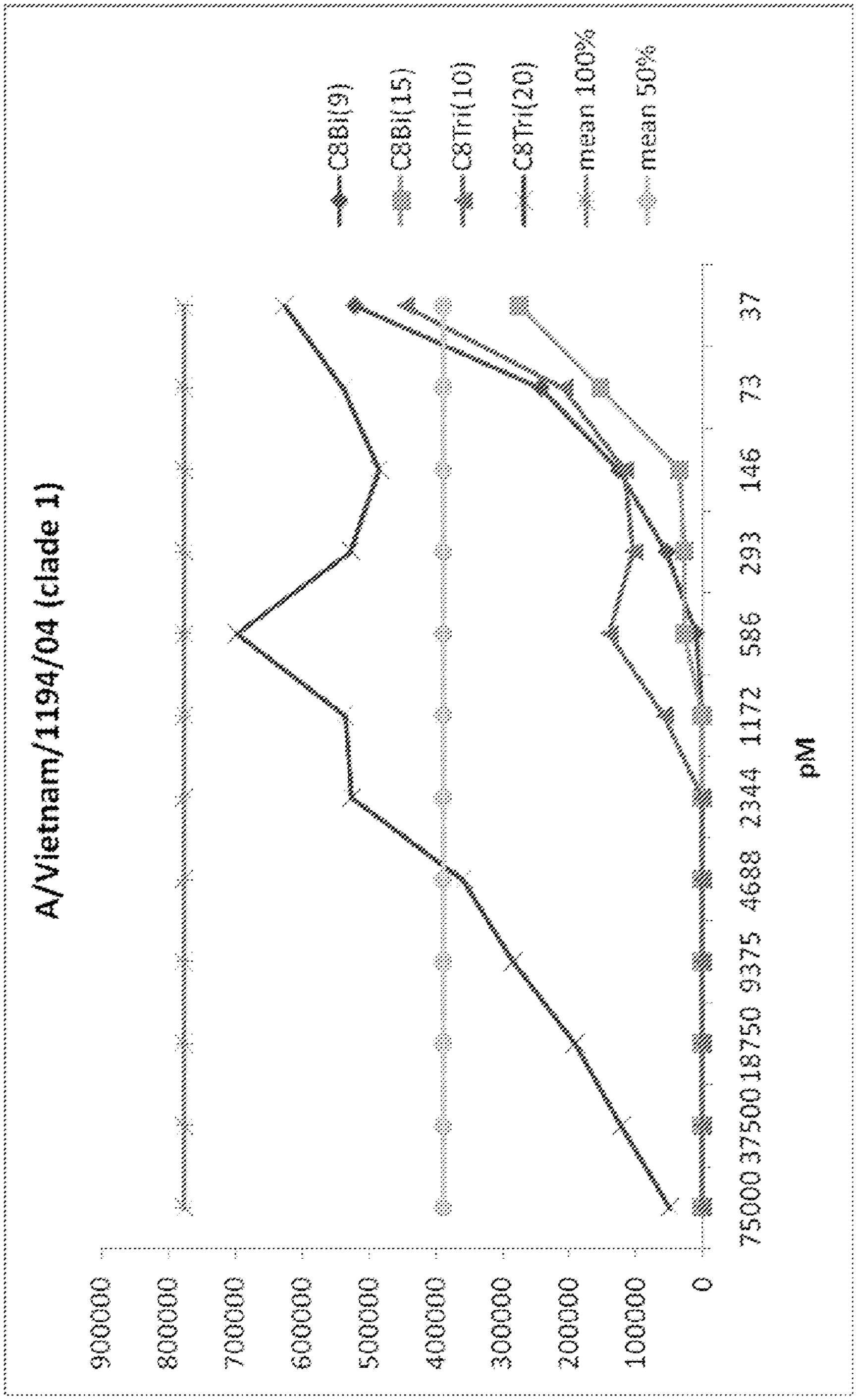
Figure 57:
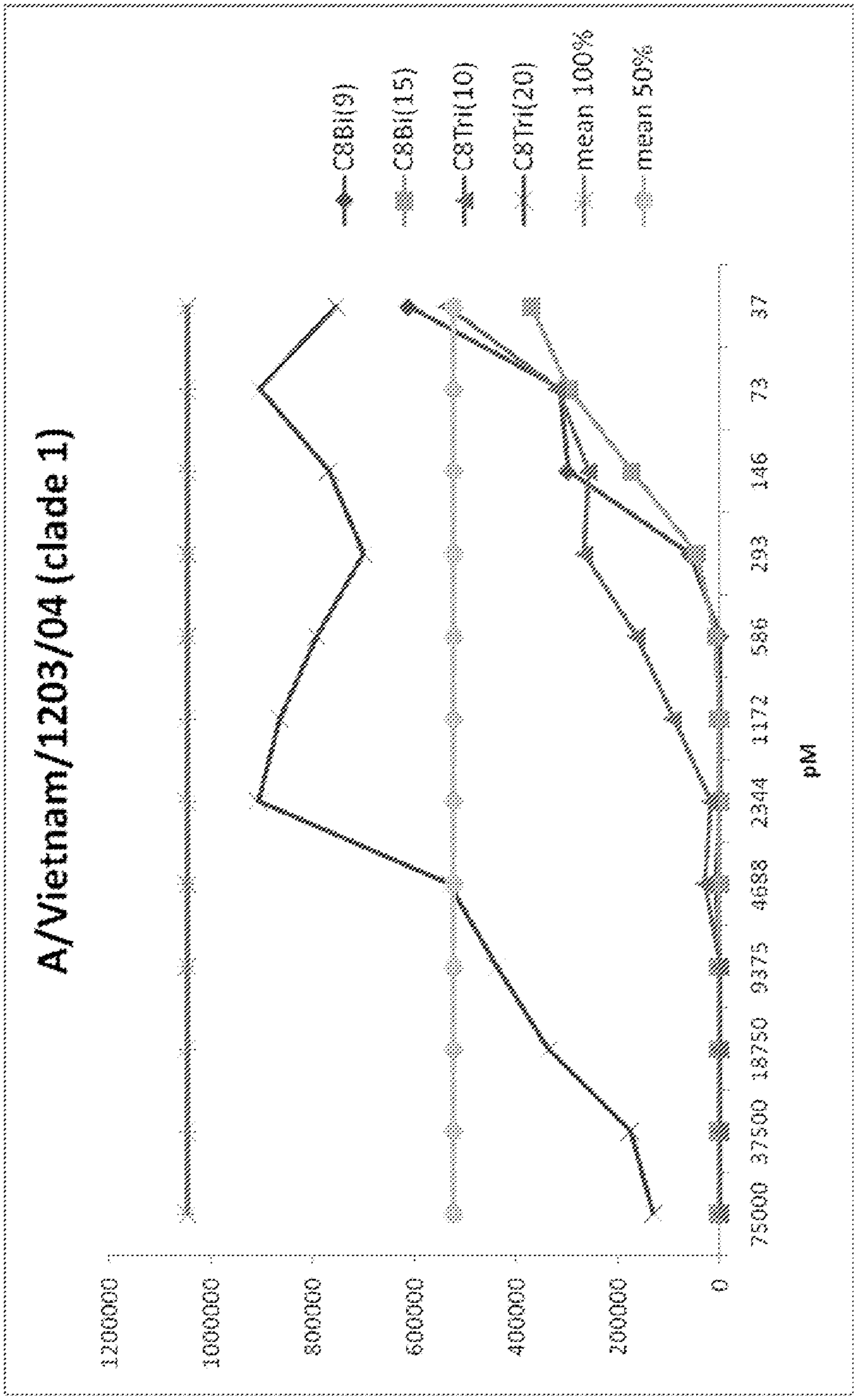
Figure 57:
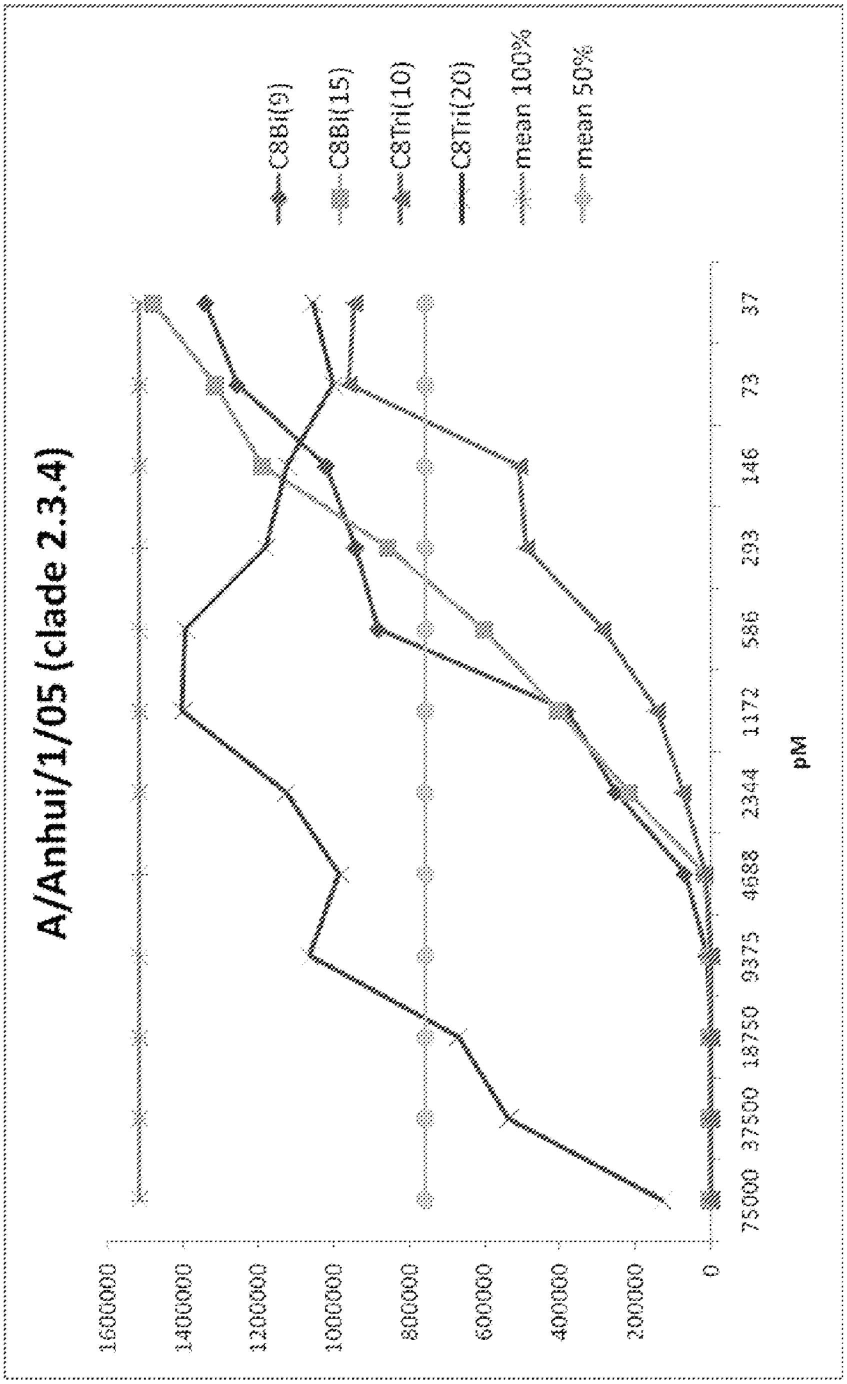
Figure 57:
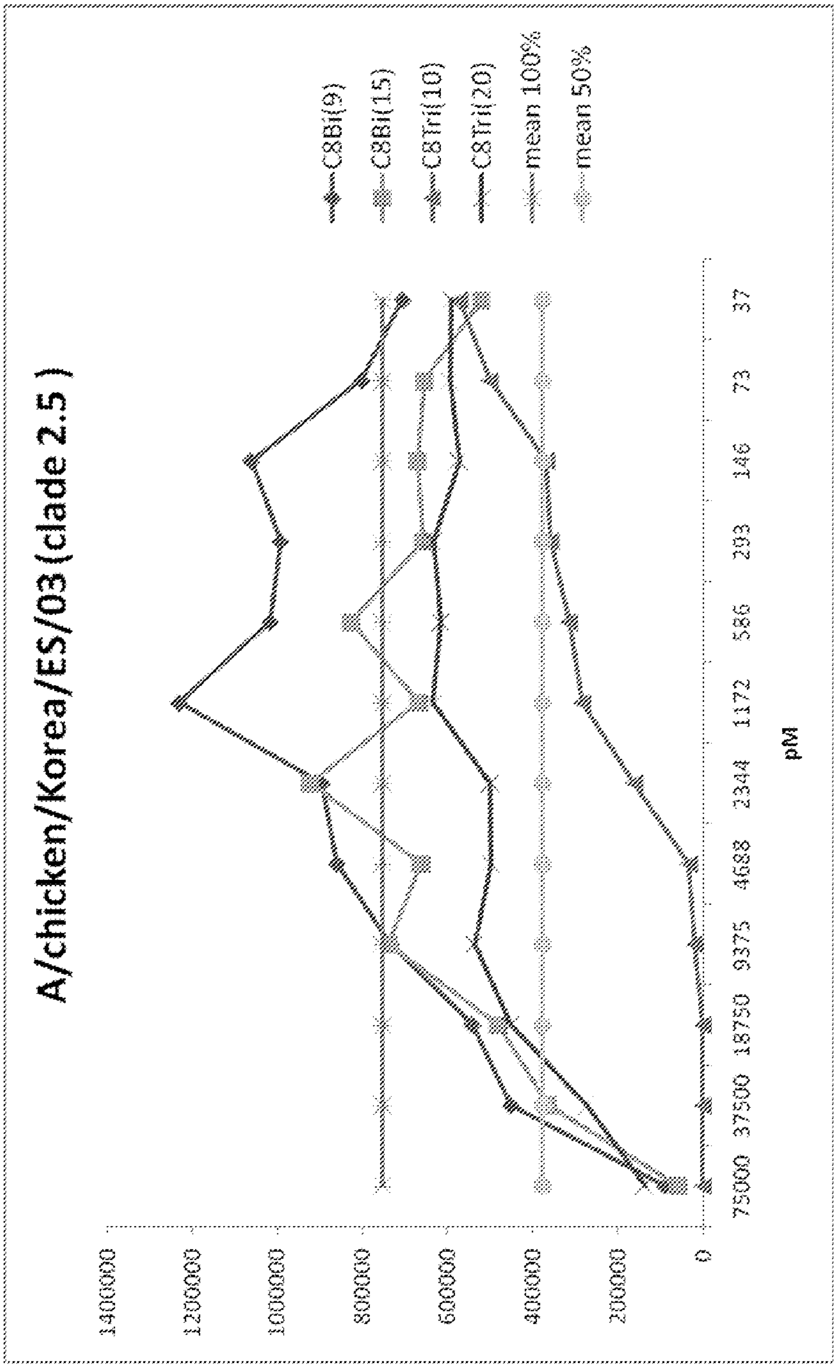
Figure 58:
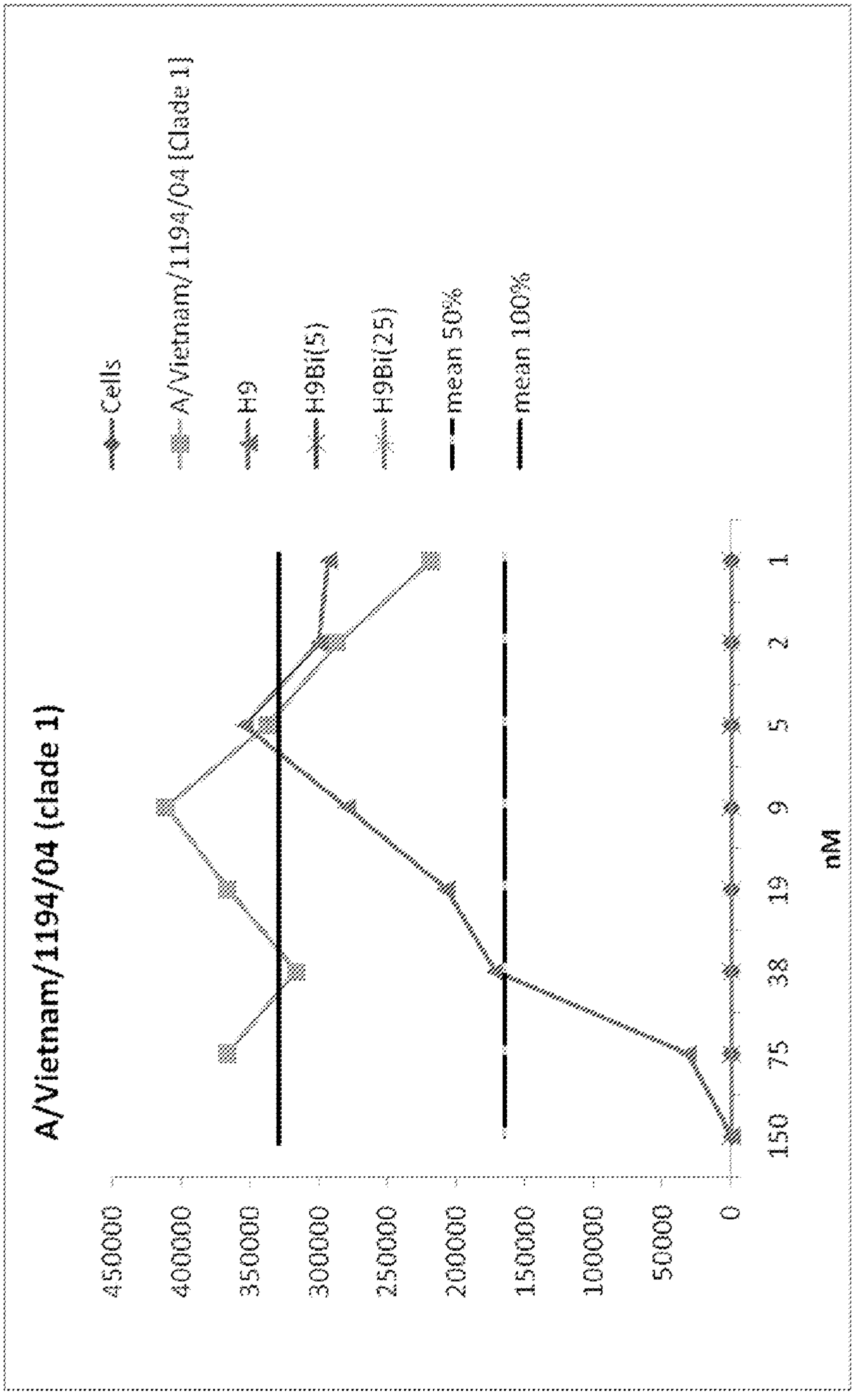
FIG. 58A-K: Neutralization of different H5 variants by different multivalent constructs of NANOBODY® ($V_{HH}$ sequence) 203-H9, tested in the lentiviral pseudotyped neutralization assay as described in Example 36. H9 refers to NANOBODY® ($V_{HH}$ sequence) 203-H9; H9Bi(5) refers to the bivalent 203-H9 NANOBODY® ($V_{HH}$ sequence) with a 5GS linker (SEQ ID NO: 2429); H9Bi(25) refers to the bivalent 203-H9 NANOBODY® ($V_{HH}$ sequence) with a 25GS linker (SEQ ID NO: 2430).
Figure 58:
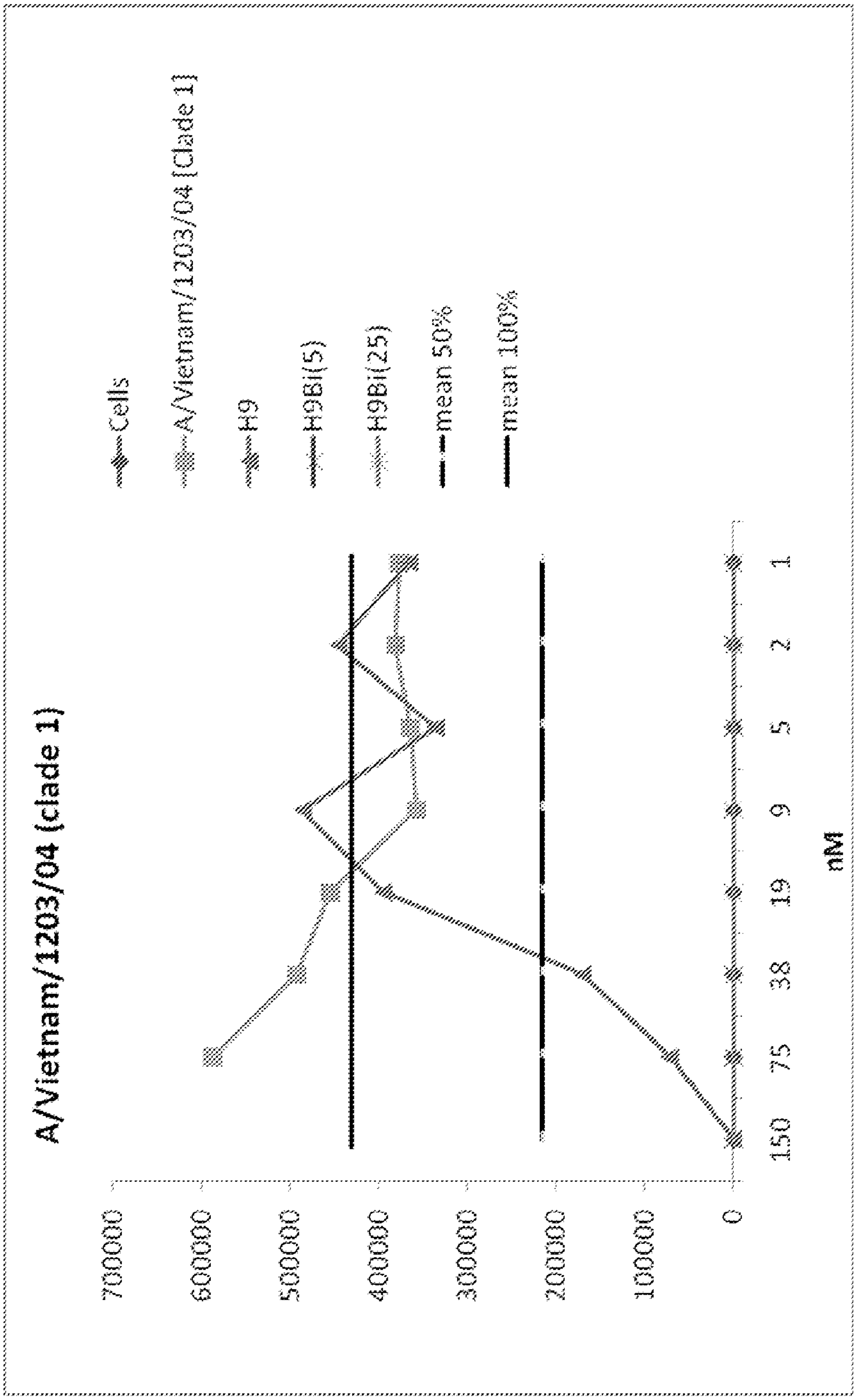
Figure 58:
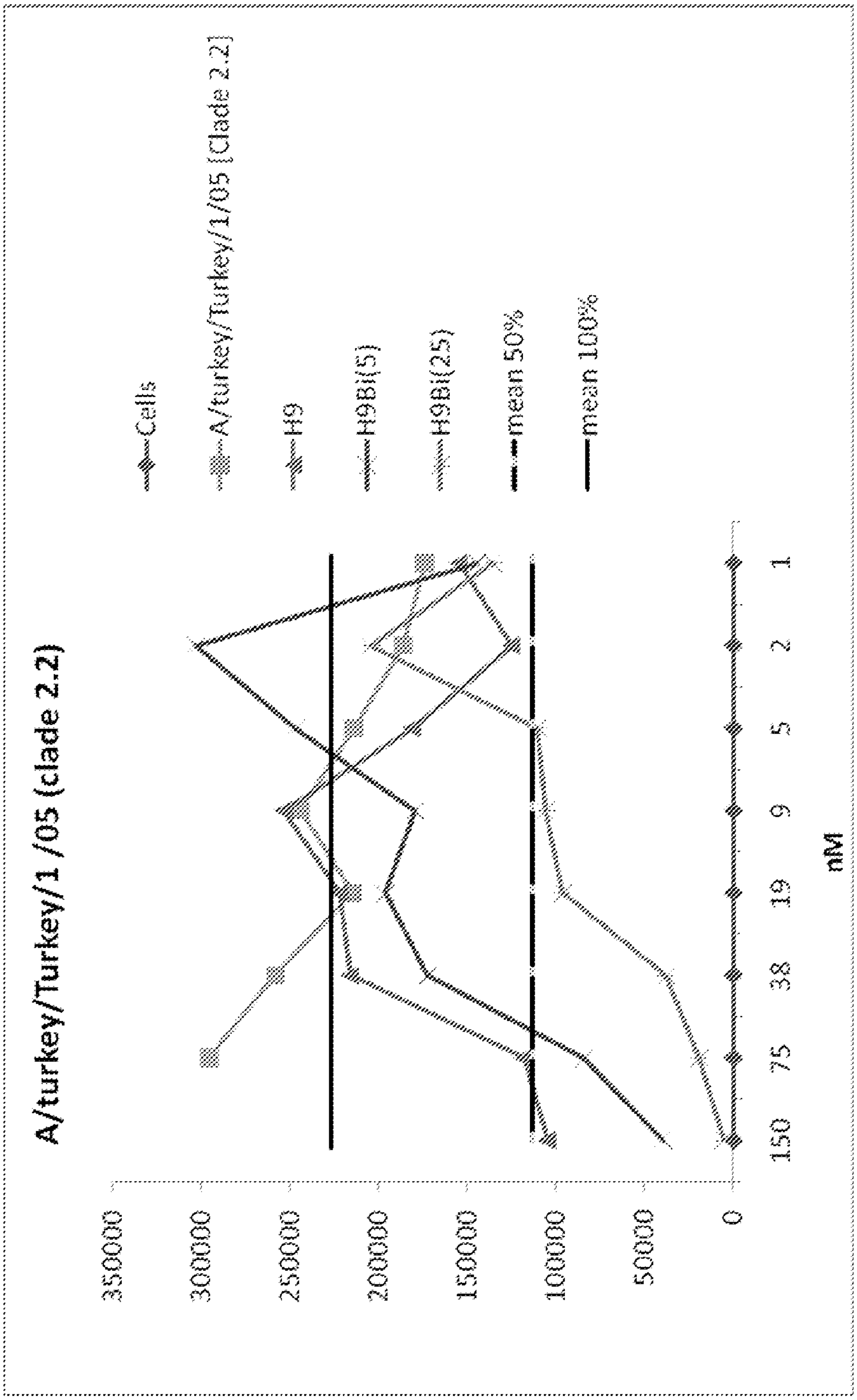
Figure 58:
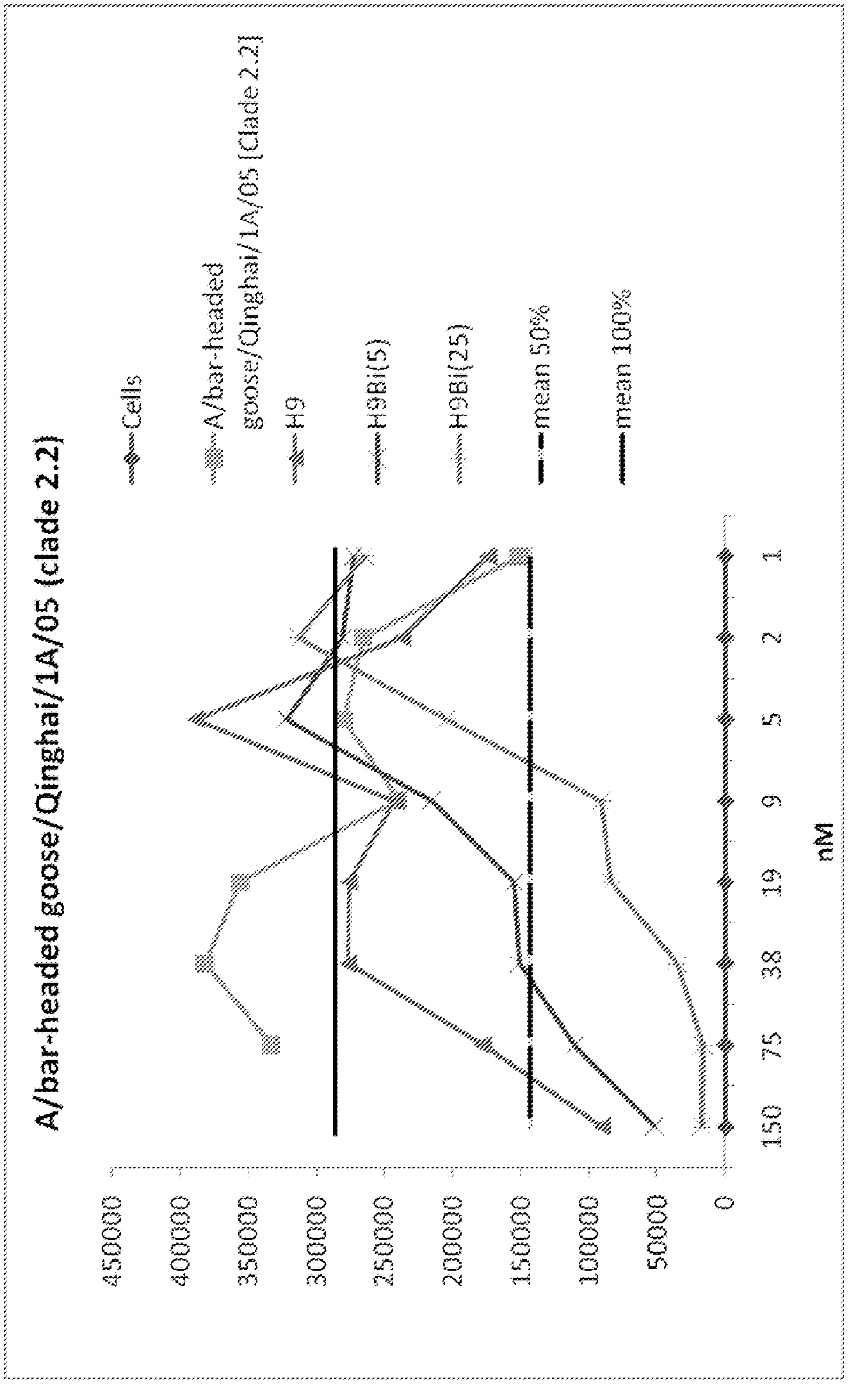
Figure 58:
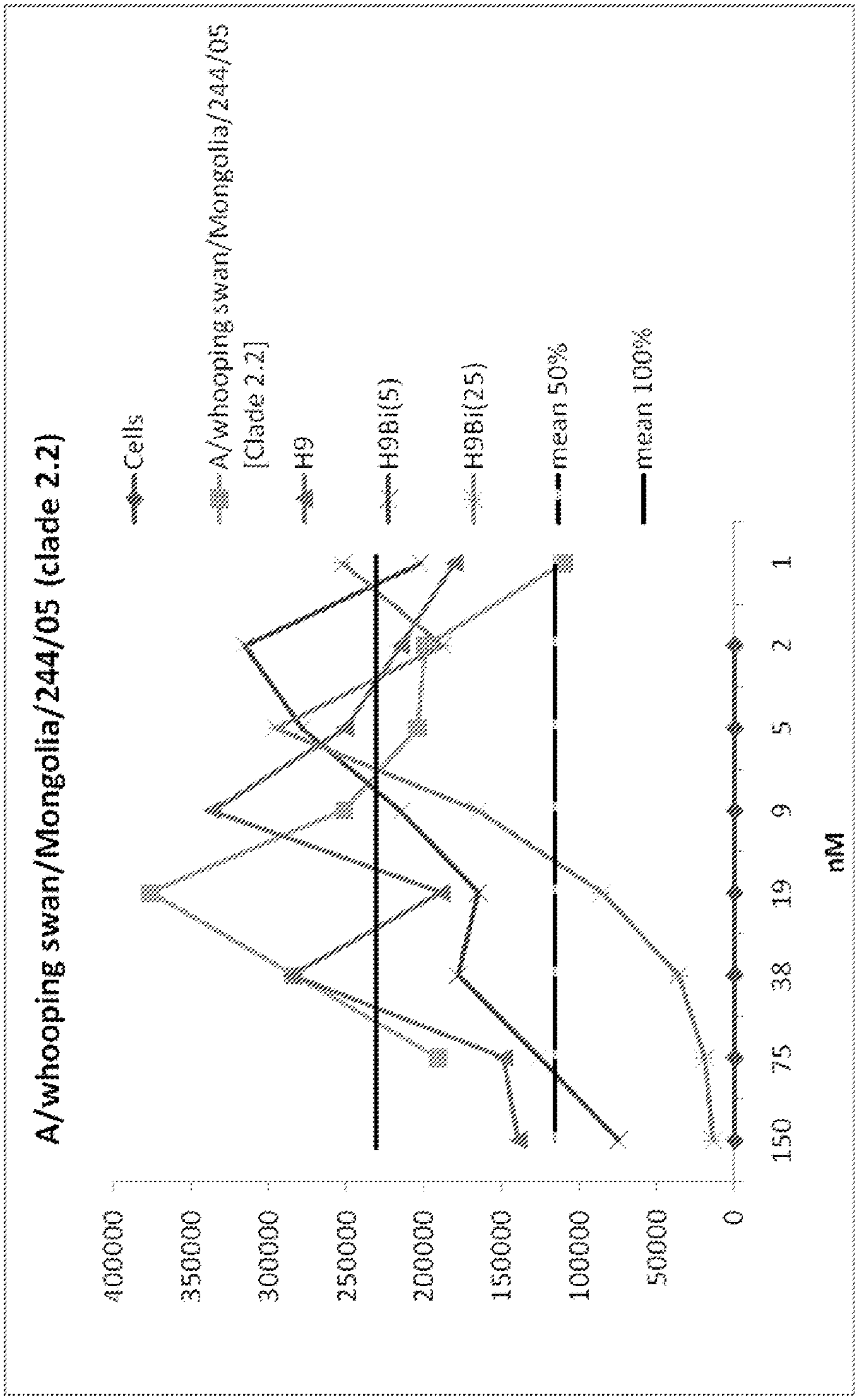
Figure 58:
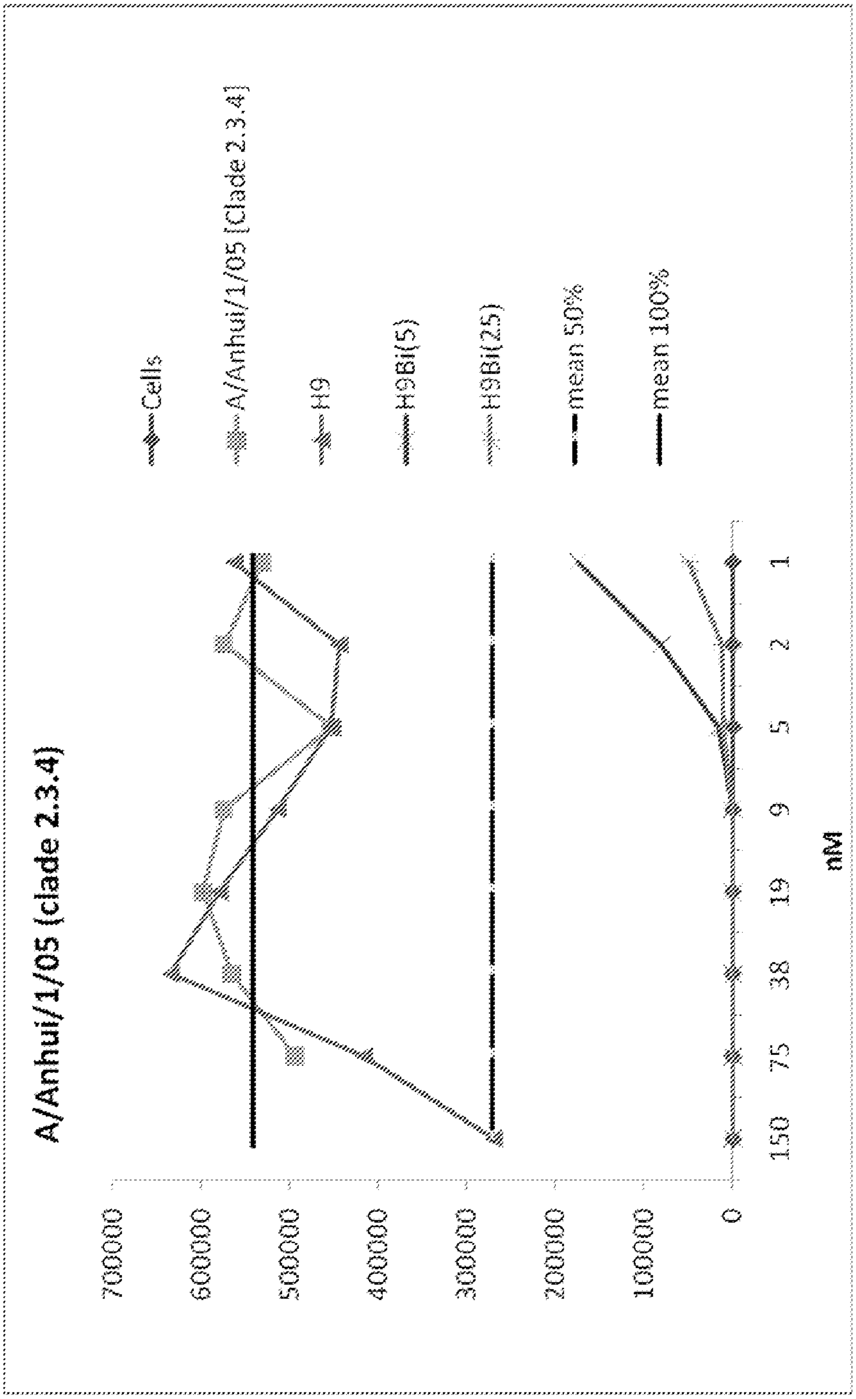
Figure 58:
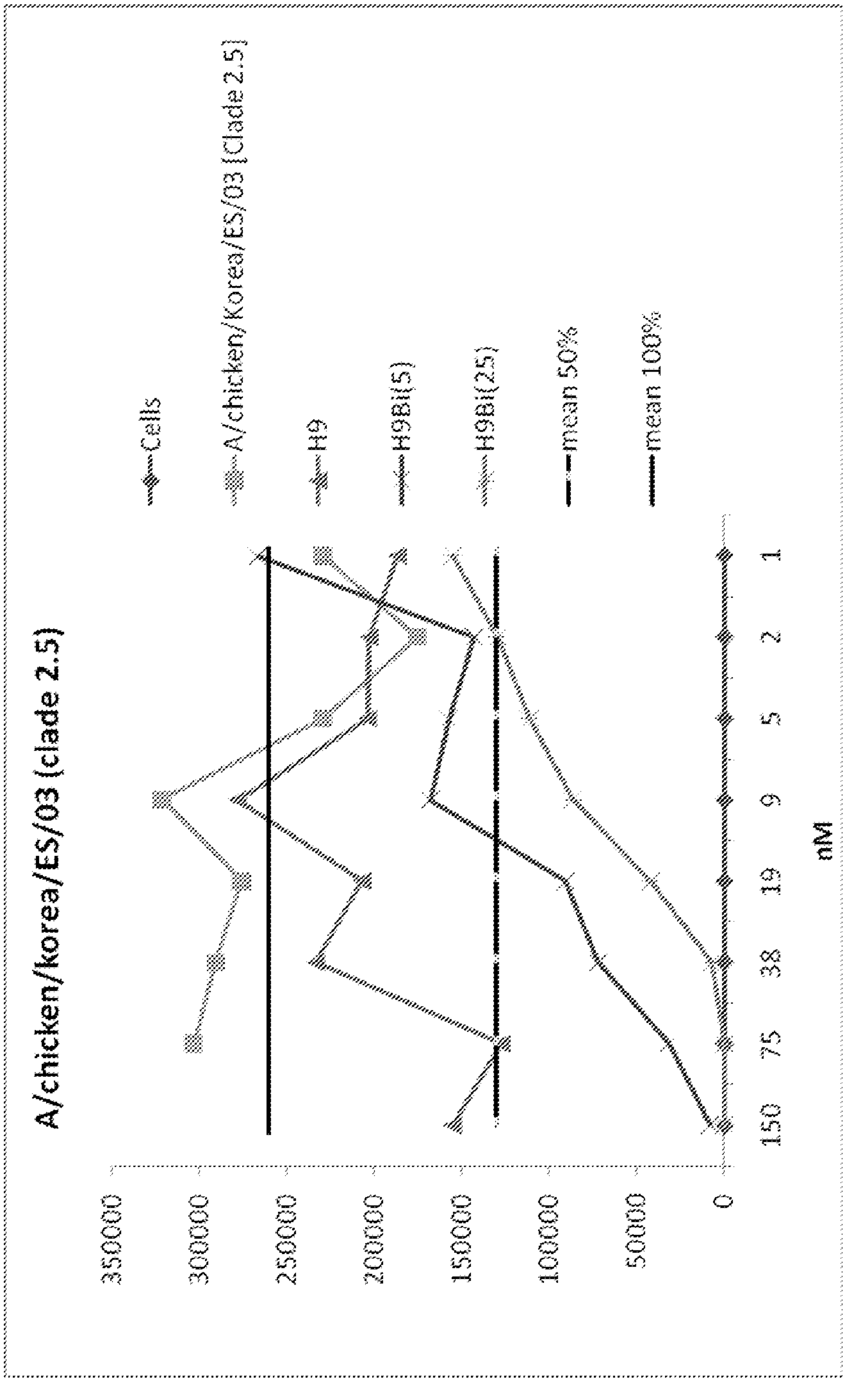
Figure 58:
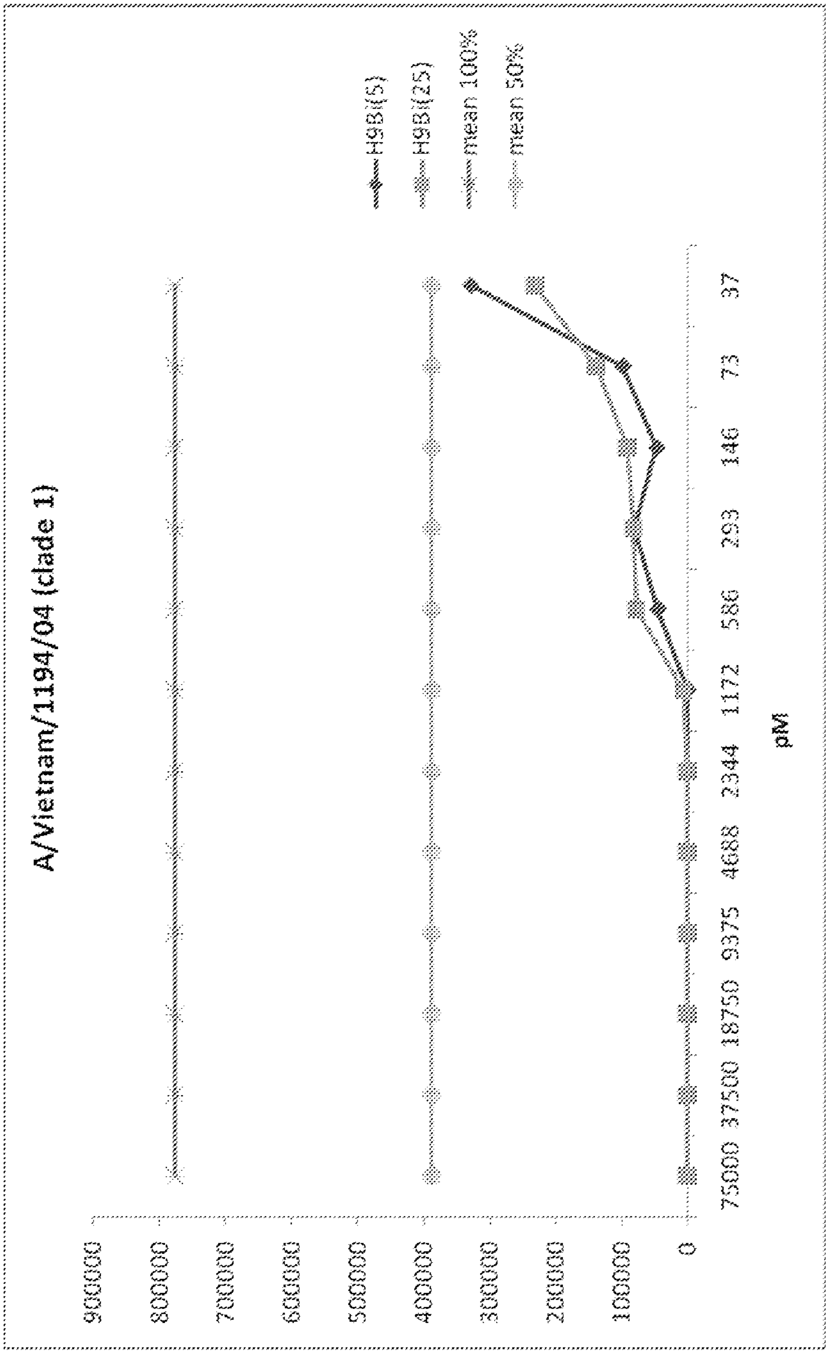
Figure 58:
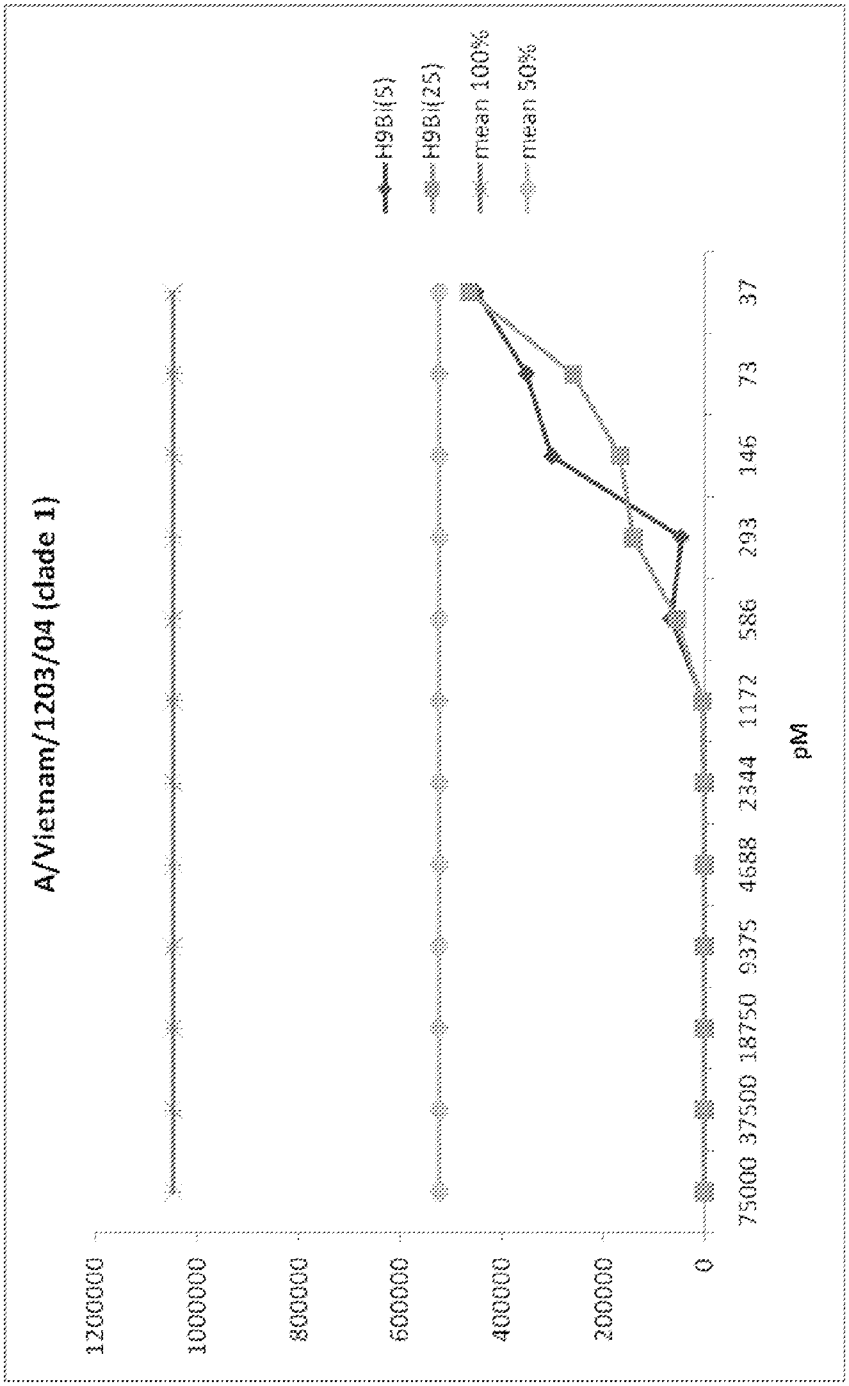
Figure 58:
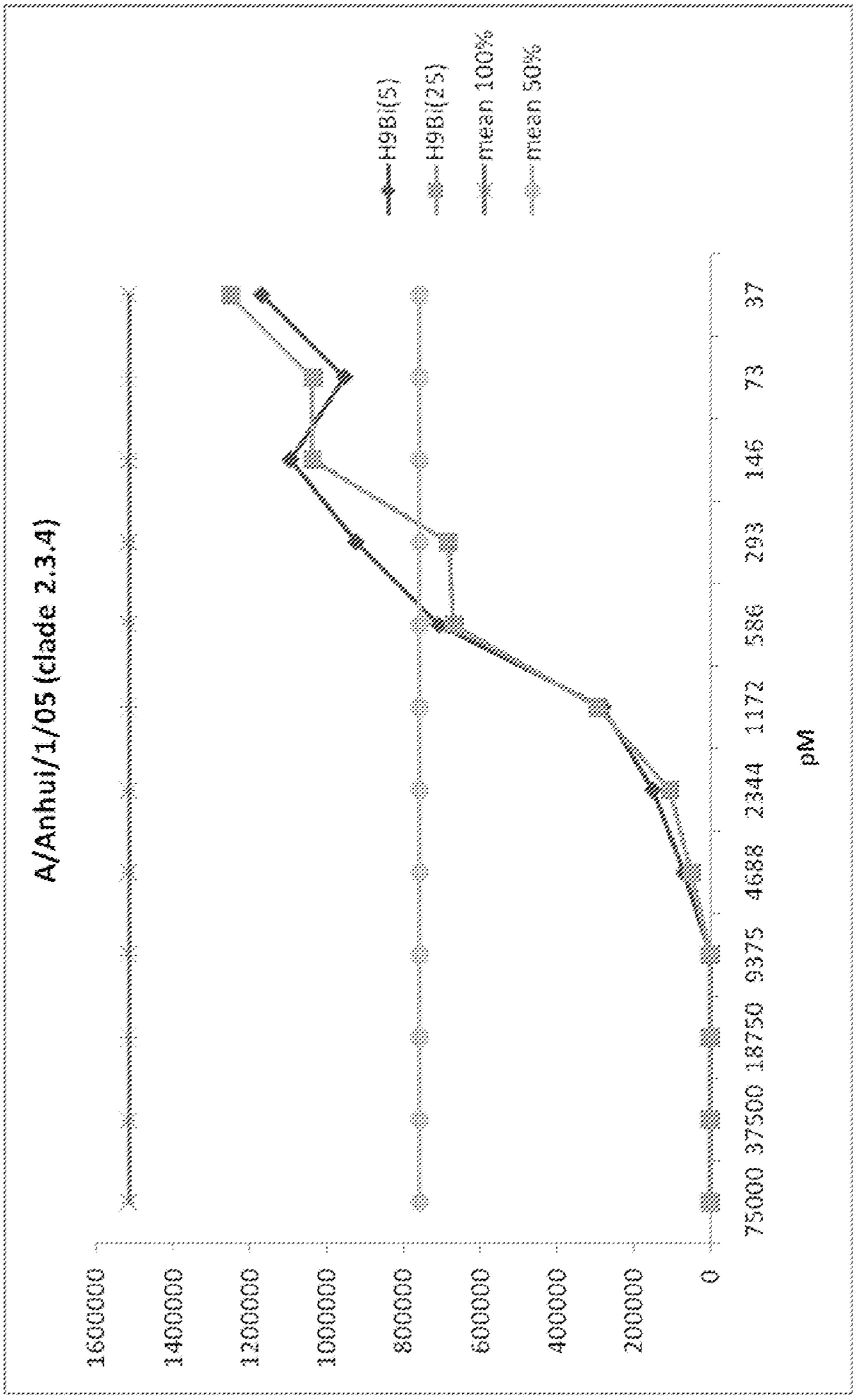
Figure 58:
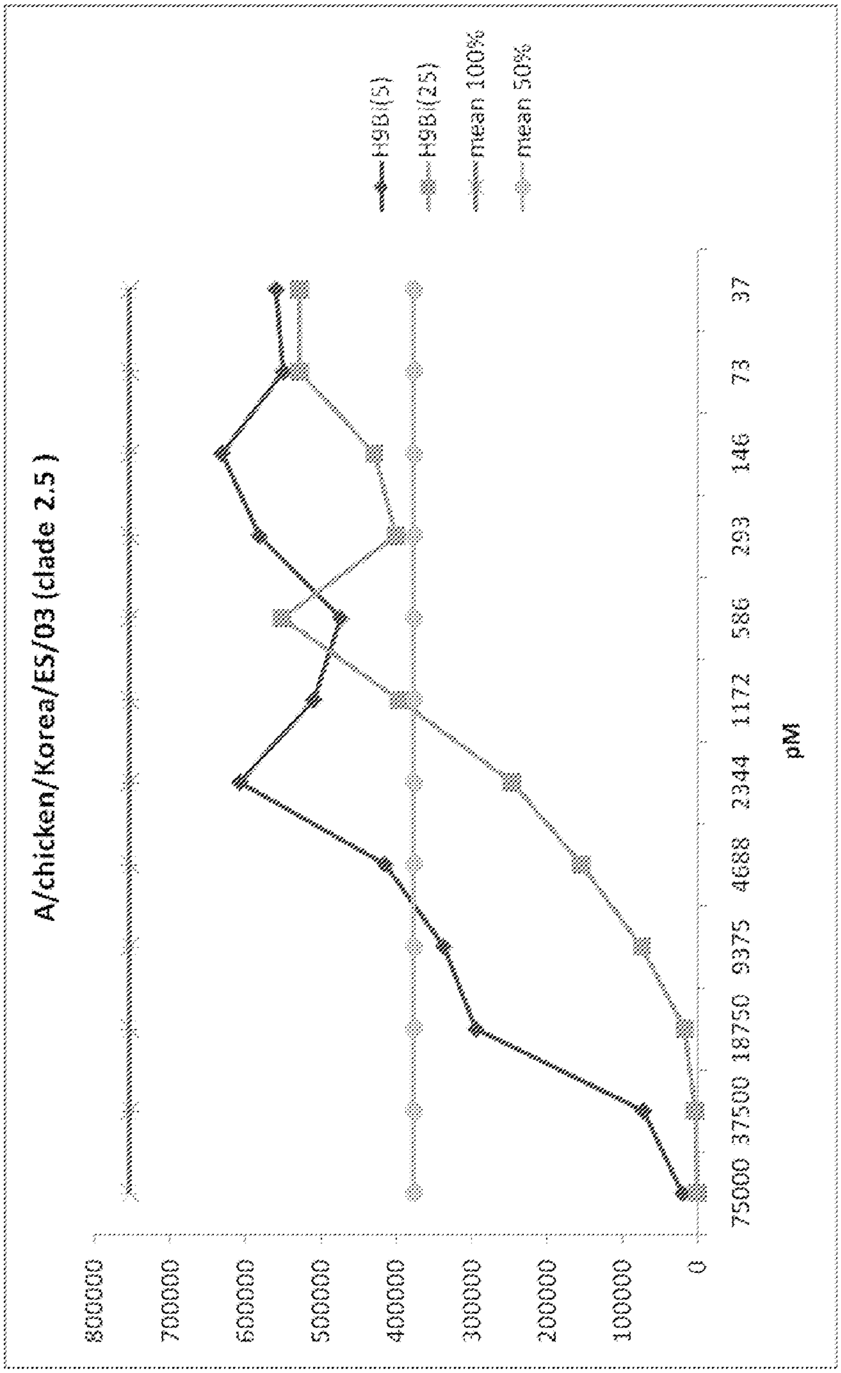
Figure 59:
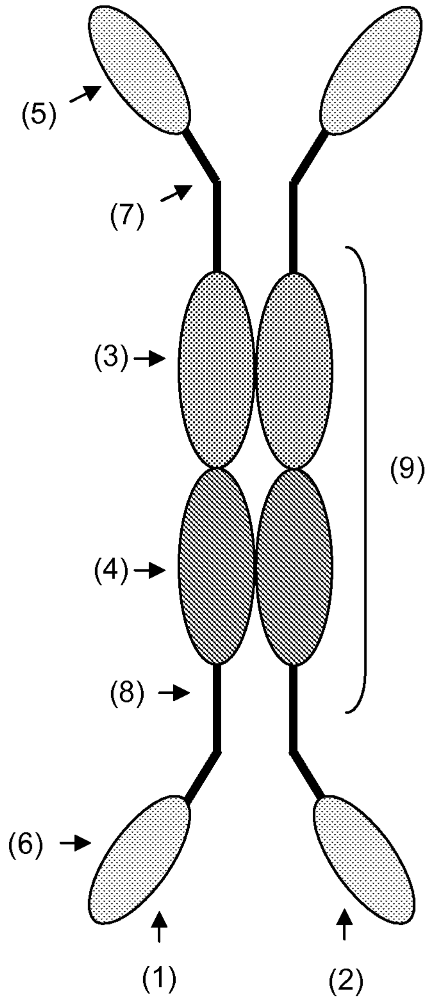
FIG. 59: Polypeptide construct with four single variable domains and four constant domains. The polypeptide chain construct comprises two polypeptide chains (1) and (2), which each comprise two constant domains (3) and (4), a "first" single variable domain (5) and a "second" single variable domain (6). The first single variable domain (5) is linked, optionally via a suitable linker or hinge region (7) to the constant domain (3). The second single variable domain (6) is linked, optionally via a suitable linker or hinge region (8) to the constant domain (4). The constant domains (3) and (4) of the polypeptide chain (1) and the corresponding constant domains (3) and (4) of the polypeptide chain (2) together form the Fc portion (9).
Figure 60:
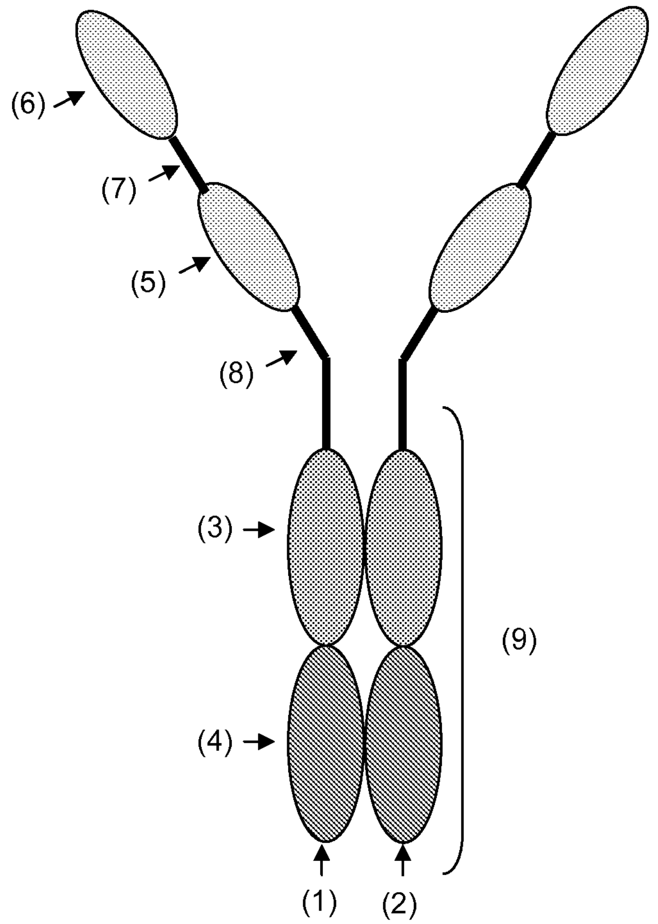
FIG. 60: Polypeptide construct with four single variable domains and four constant domains. The polypeptide chain construct comprises two polypeptide chains (1) and (2), which each comprise two constant domains (3) and (4), a "first" single variable domain (5) and a "second" single variable domain (6). The first single variable domain (5) is linked, optionally via a suitable linker (7), to the second single variable domain (6), and is also linked to the constant domains, optionally (and usually) via a suitable linker or hinge region (8). The constant domains (3) and (4) of the polypeptide chain (1) and the corresponding constant domains (3) and (4) of the polypeptide chain (2) together form the Fc portion (9).
Figure 61:
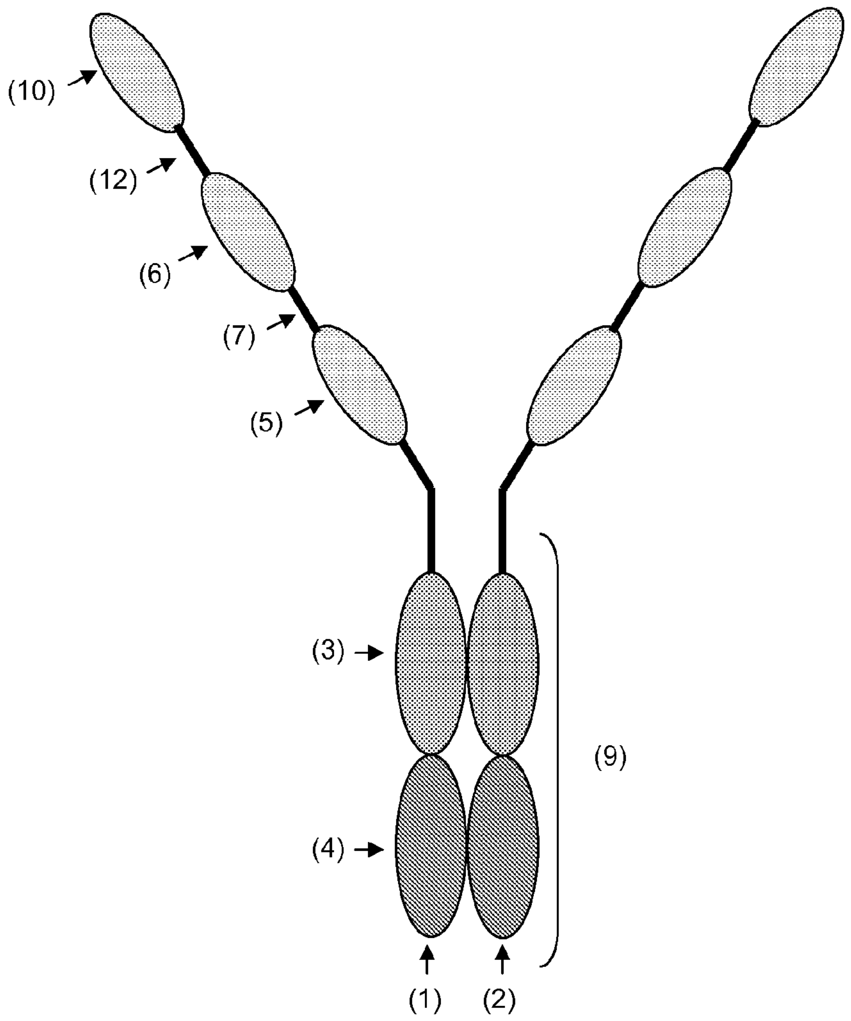
FIG. 61: Polypeptide construct with six single variable domains and four constant domains. The polypeptide chain construct comprises two polypeptide chains (1) and (2), which each comprise two constant domains (3) and (4), a "first" single variable domain (5), a "second" single variable domain (6) and a "third" single variable domain (10). The first single variable domain (5) is linked, optionally via a suitable linker (7), to the second single variable domain (6), and is also linked to the constant domains, optionally (and usually) via a suitable linker or hinge region (8). The third single variable domain (11) is linked, optionally via a suitable linker (12), to the second single variable domain (6). The constant domains (3) and (4) of the polypeptide chain (1) and the corresponding constant domains (3) and (4) of the polypeptide chain (2) together form the Fc portion (9).
Figure 62:
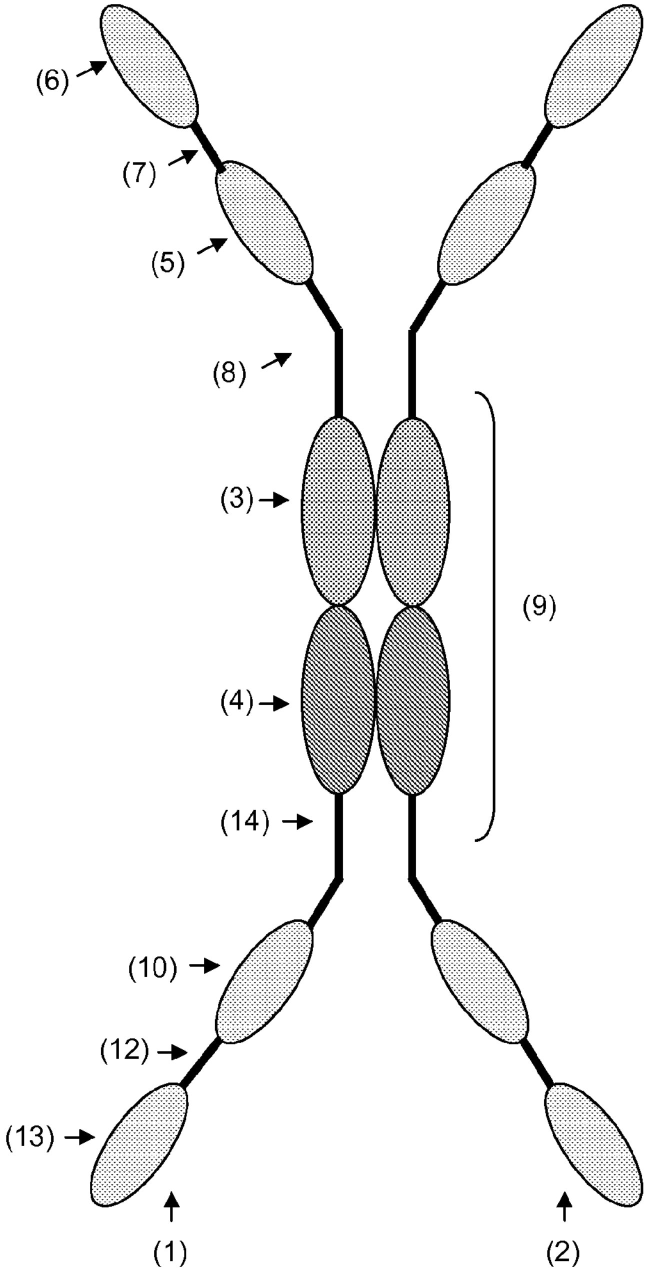
FIG. 62: Polypeptide chain construct with eight single variable domains and four constant domains. The polypeptide chain construct comprises two polypeptide chains (1) and (2), which each comprise two constant domains (3) and (4), a "first" single variable domain (5), a "second" single variable domain (6), a "third" single variable domain (10) and a "fourth" single variable domain (13). The first single variable domain (5) is linked, optionally via a suitable linker (7), to the second single variable domain (6), and is also linked to the constant domain (3), optionally (and usually) via a suitable linker or hinge region (8). The third single variable domain (10) is linked, optionally via a suitable linker (12), to the fourth single variable domain (13), and is also linked to the constant domain (4), optionally (and usually) via a suitable linker or hinge region (14). The constant domains (3) and (4) of the polypeptide chain (1) and the corresponding constant domains (3) and (4) of the polypeptide chain (2) together form the Fc portion (9).
Figure 63:
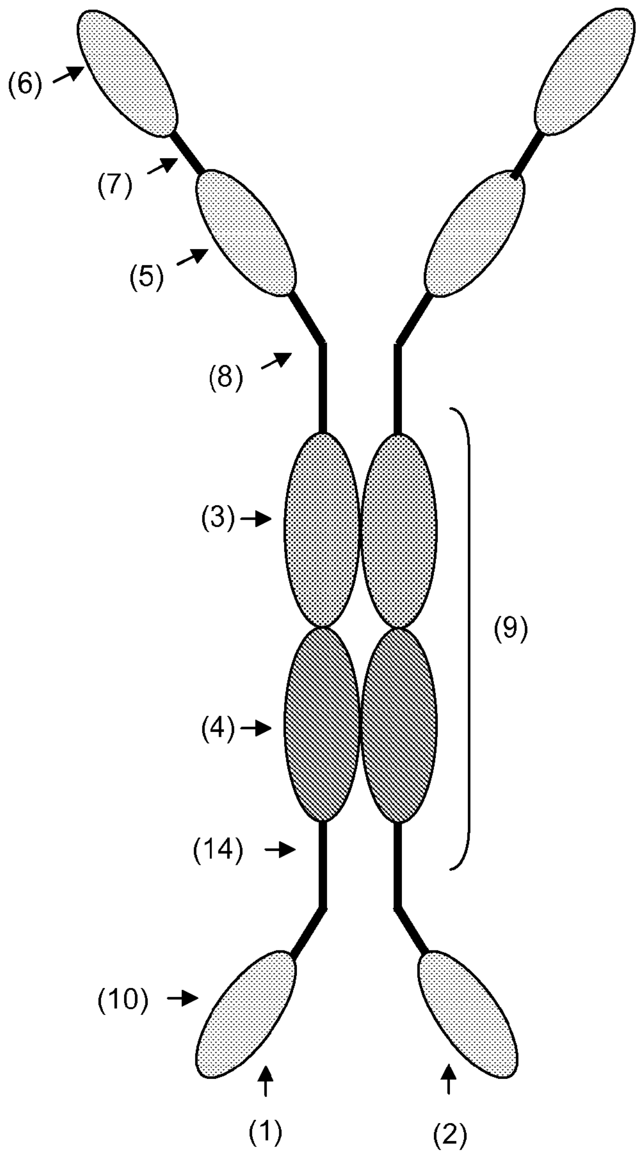
FIG. 63: Polypeptide chain construct with six single variable domains and four constant domains. The polypeptide chain construct comprises two polypeptide chains (1) and (2), which each comprise two constant domains (3) and (4), a "first" single variable domain (5), a "second" single variable domain (6) and a "third" single variable domain (10). The first single variable domain (5) is linked, optionally via a suitable linker (7), to the second single variable domain (6), and is also linked to the constant domain (3), optionally (and usually) via a suitable linker or hinge region (8). The third single variable domain (10) is linked to the constant domain (4), optionally (and usually) via a suitable linker or hinge region (14). The constant domains (3) and (4) of the polypeptide chain (1) and the corresponding constant domains (3) and (4) of the polypeptide chain (2) together form the Fc portion (9).
Figure 64:
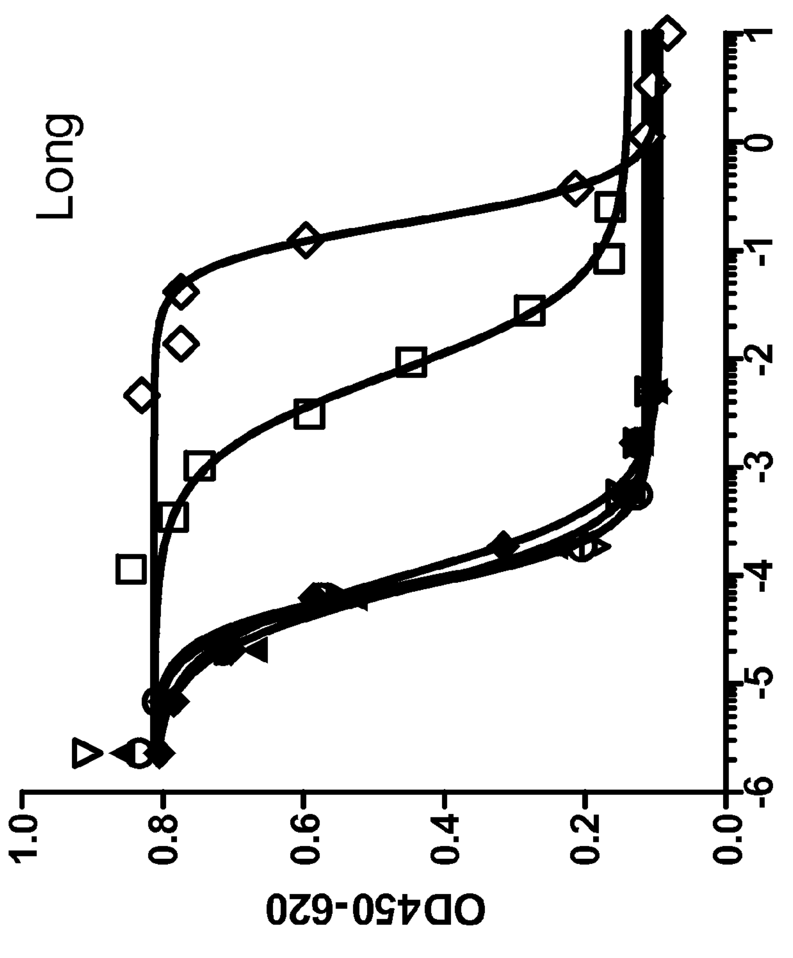
FIG. 64A-B: Neutralization of RSV Long and RSV B-1 strains by trivalent NC41 NANOBODY® ($V_{HH}$ sequence) with different linker lengths as described in Example 58.
Figure 64:
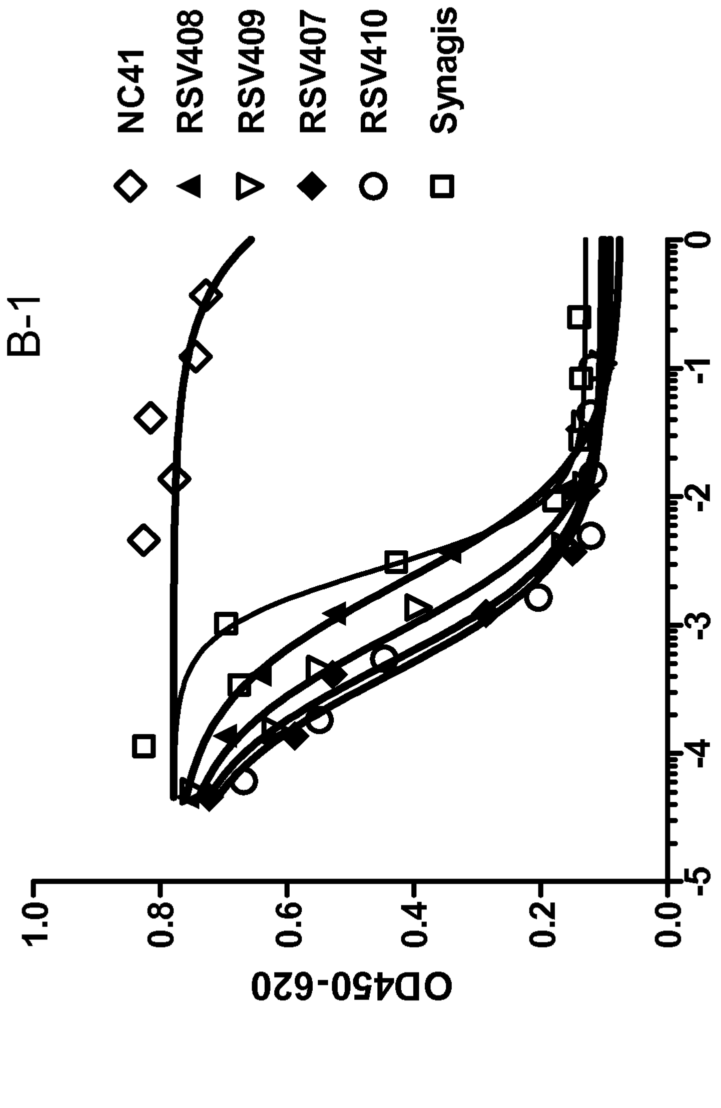

When bivalent and trivalent NANOBODIES® ($V_{HH}$ sequences) with different linker lengths from 202-C8 and 203-H9 were tested against these different H5 variants using the lentiviral pseudotyped neutralization assays all bivalent and trivalent NANOBODIES® ($V_{HH}$ sequences) showed superior neutralization potencies compared to the monovalent building blocs (FIGS. 57 and 58). While certain viruses where hardly neutralized by the monovalent, such variants were efficiently neutralized by bivalent and/or trivalent NANOBODIES® ($V_{HH}$ sequences).

Example 37

In Vivo Neutralization of Influenza Virus by NANOBODY® ($V_{HH}$ Sequence) 202-C8

To test the capacity of NANOBODY® ($V_{HH}$ sequence) 202-C8 to neutralize virus in vivo, a mouse model was used. In this model, female Balb/c mice (6-7 weeks old) were inoculated intranasally with 100 μg of purified 202-C8 dissolved in 50 μl PBS. As an irrelevant NANOBODY® ($V_{HH}$ sequence) control, the RSV NANOBODY® ($V_{HH}$ sequence) 191-D3 (SEQ ID NO: 159) was used. In addition, one group of mice received PBS only. Four hours later, 1 LD50 of the mouse adapted NIBRG-14 virus (Temperton et al. 2007) was administered intranasally. The NIBRG-14 virus contains the HA (with the polybasic cleavage site removed) and the NA of the A/Vietnam/1194/2004 (H5N1) virus. The internal viral genes are of the A/Puerto Rico/8/1934(H1N1).

Four and six days after viral challenge, mice were killed, lungs were removed and homogenized. Viral titers (TCID50) were determined by infection of MDCK cells with serial dilutions of lung homogenates. The presence of virus in cell supernatant was determined by hemagglutination assays (Table C-10). Titers were calculated according the method of Reed, L. J. and Muench, H. 1938 (A simple method of estimating fifty percent endpoints. The American Journal of Hygiene 27: 493-497). A value of "0" was entered if no virus was detected. The geometric mean and standard deviation are reported for each group at each time point.

Mice treated with 202-C8 never showed any sign of disease during the whole experiment. The PBS and 191-D3-treated mice showed clinical signs, including ruffled fur, inactivity, hunched posture, and depression.

Virus was recovered from all animals in the negative control groups (PBS and 191-D3) in lung homogenates on day 4 and 6 after challenge. None of the animals in the 202-C8-treated group had detectable virus titers on day 4 and 6 post challenge (Table C-10).

Example 38

Functionality of NANOBODY® ($V_{HH}$ Sequence) 202-C8 in the Lungs after Inoculation To test how long NANOBODY® ($V_{HH}$ sequence) 202-C8 remains active in the lungs after intranasal inoculation, female Balb/c mice (6-7 weeks old) were inoculated intranasally with 100 g of purified 202-C8 dissolved in 50 l PBS. As an irrelevant NANOBODY® ($V_{HH}$ sequence) control the RSV NANOBODY® ($V_{HH}$ sequence) 191-D3 was used. In addition, one group of mice received PBS only. All mice received 1 LD50 of the mouse adapted NIBRG-14 intranasally, but virus was given 4, 24 or 48 hours after inoculation of the NANOBODIES® ($V_{HH}$ sequences). Four days after viral challenge, mice were killed, lungs were removed and homogenized. Viral titers (TCID50) were determined by infection of MDCK cells with serial dilutions of lung homogenates. The presence of virus in cell supernatant was determined by hemagglutination assays. Titers were calculated according the method of Muench and Reed. A value of “0” was entered if no virus was detected. The geometric mean and standard deviation are reported for each group at each time point (Table C-11).

Figure 32:
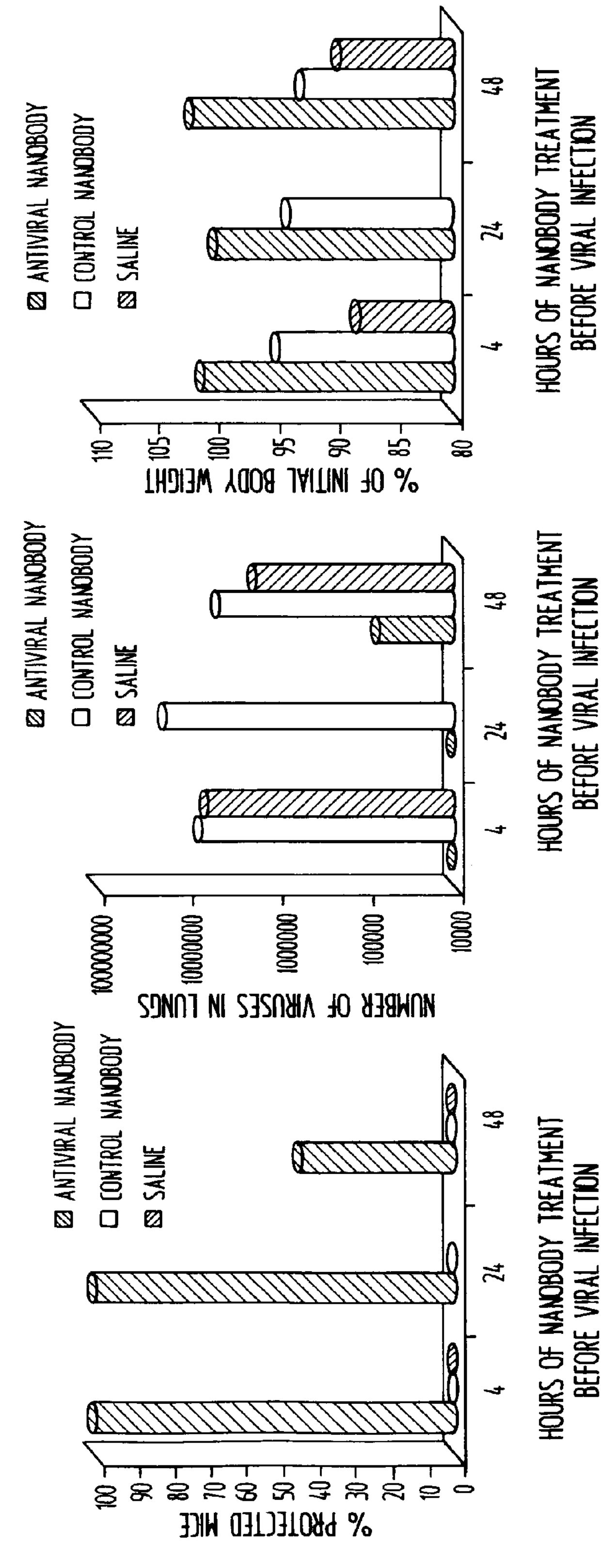
FIG. 32: Intranasal delivery of NANOBODY® ($V_{HH}$ sequence) 202-C8 protects against infection and replication of mouse-adapted NIBRG-14 virus as described in Example 38.

Mice pretreated with 202-C8 never showed any signs of disease during the whole experiment. The PBS and 19-D3-treated mice showed clinical signs, including ruffled fur, inactivity, hunched posture, and depression and a reduction in body weight (FIG. 32, right panel).

Virus was recovered from all animals pretreated with the control NANOBODY® ($V_{HH}$ sequence) 191-D3 or PBS. Virus could not be detected in the lungs of mice that were treated with 202-C8, 4 and 24 hours before virus inoculation. No virus could be detected in lungs of three mice of seven treated with 202-C8 48 hours before virus inoculation (FIG. 32, left panel and Table C-11). Viral titers in the remaining 4 mice were on average reduced 50 fold compared to the viral titers found in the lungs of mice treated with 191-D3 48 hours before vial inoculation.

Taken together, these data show that the monovalent NANOBODY® ($V_{HH}$ sequence) 202-C8 remains actively present in the lungs for at least 48 hours after intranasal administration.

Example 39

Surface Plasmon Resonance for Affinity Measurements

Figure 33:
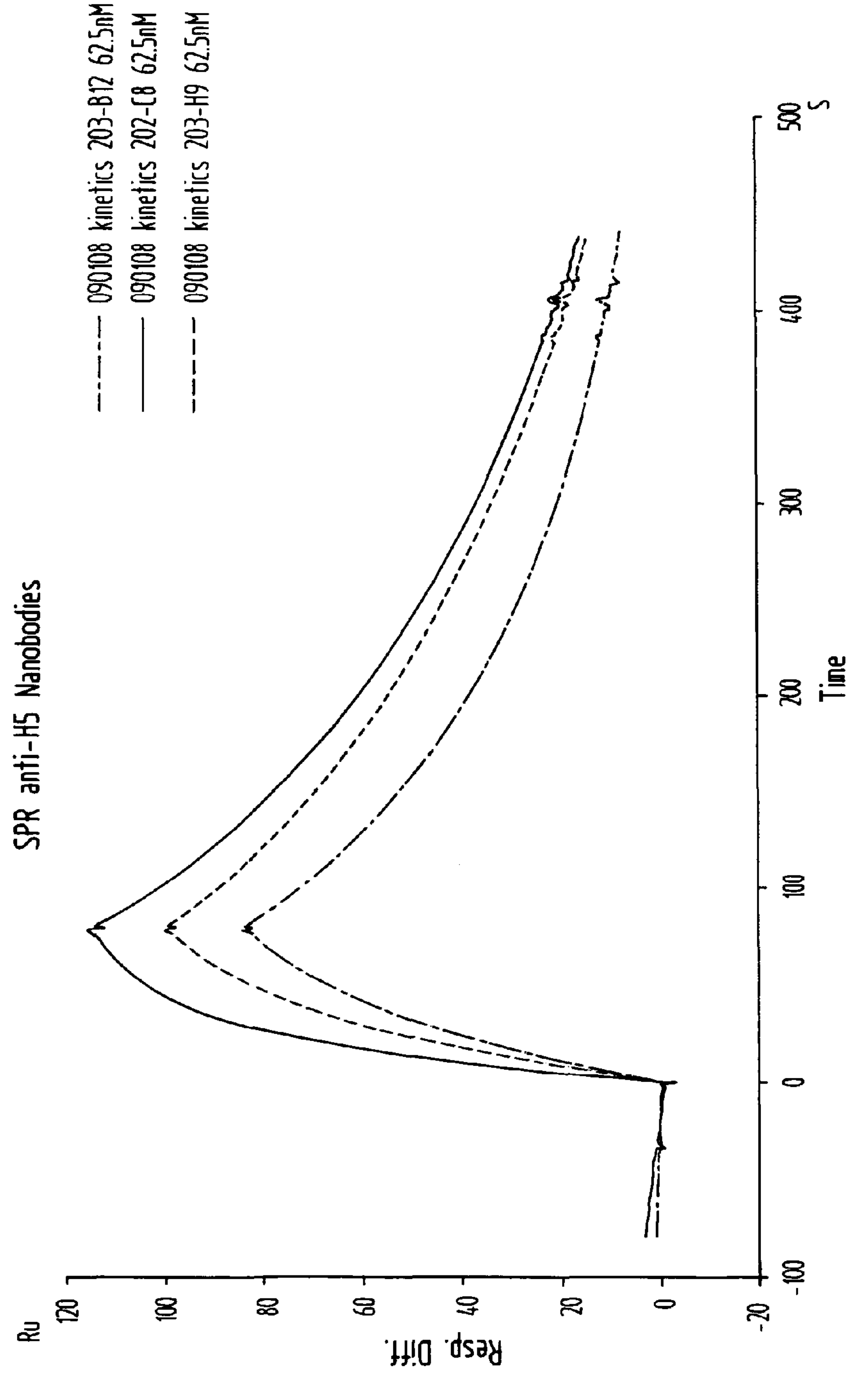
FIG. 33: Kinetic sensogram showing the binding capacity for the neutralizing NANOBODIES® ($V_{HH}$ sequences) 202-C8, 203-B12 and 203-H9.

To measure the affinity of selected NANOBODIES® ($V_{HH}$ sequences), Surface Plasmon resonance was used. Two thousand Reference units (RU), H5 was coupled on a Sensorchip CM5 in 10 mM sodium acetate pH 5.5 and immobilized by aminecoupling (Biacore, aminecoupling kit). Dilutions of the NANOBODIES® ($V_{HH}$ sequences) were added at concentrations 250-62.5 nM and run over a reference flow channel with no HA and then over the HA coupled flow channel at a flow rate of 5 μl/min. Evaluation of the KA and KD was performed by fitting a 1:1 interaction model (Langmuir binding model), removing the background from the reference flow channel. The kinetic curves of the NANOBODIES® ($V_{HH}$ sequences) (62.5 nM) are shown in FIG. 33. The 202-C8 has a KD of 10 nM, the 203-B12 of 30 nM and the 203-H9 of 15.5 nM.

Example 40

Determination of Binding Efficacy of Purified Multivalent NANOBODIES® ($V_{HH}$ Sequences) to H5

Figure 34:
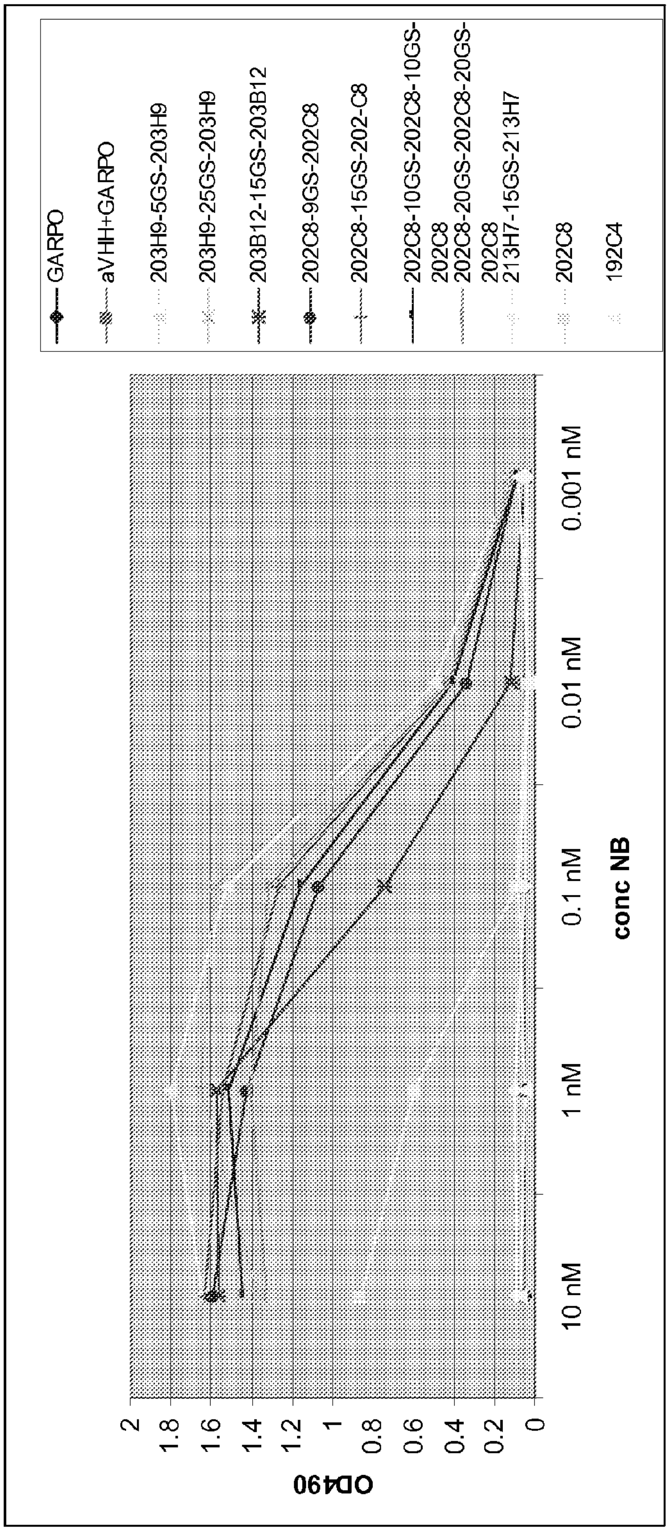
FIG. 34: Binding assay (ELISA) with a dilution series of purified multivalent anti-H5 HA NANOBODIES® ($V_{HH}$ sequences) as described in Example 40.

In order to determine binding specificity to H5, the different multivalent NANOBODIES® ($V_{HH}$ sequences) were tested in an ELISA binding assay in different concentrations. In short, 2 μg/ml of H5 were immobilized directly on Maxisorp microtiter plates (Nunc). Free binding sites were blocked using 4% Marvel in PBS. Next, Dilutions (1/10) of the NANOBODIES® ($V_{HH}$ sequences) starting with 10 pM in 100 μl 2% Marvel PBST were allowed to bind to the immobilized antigen. After incubation and a wash step, NANOBODY® ($V_{HH}$ sequence) binding was revealed using a rabbit-anti-VHH secondary antibody (a VHH). After a wash step the NANOBODIES® ($V_{HH}$ sequences) were detected with a HRP-conjugated goat-anti-rabbit antibody (GARPO). Binding specificity was determined based on OD values compared to controls (192-C4; SEQ ID NO: 163) against HRSV and 213-H7-15GS-213-H7 (SEQ ID NO: 2427) against Rabies). The multivalent NANOBODIES® ($V_{HH}$ sequences) show higher binding capacity than the monovalent (FIG. 34).

Example 41

Figure 35:
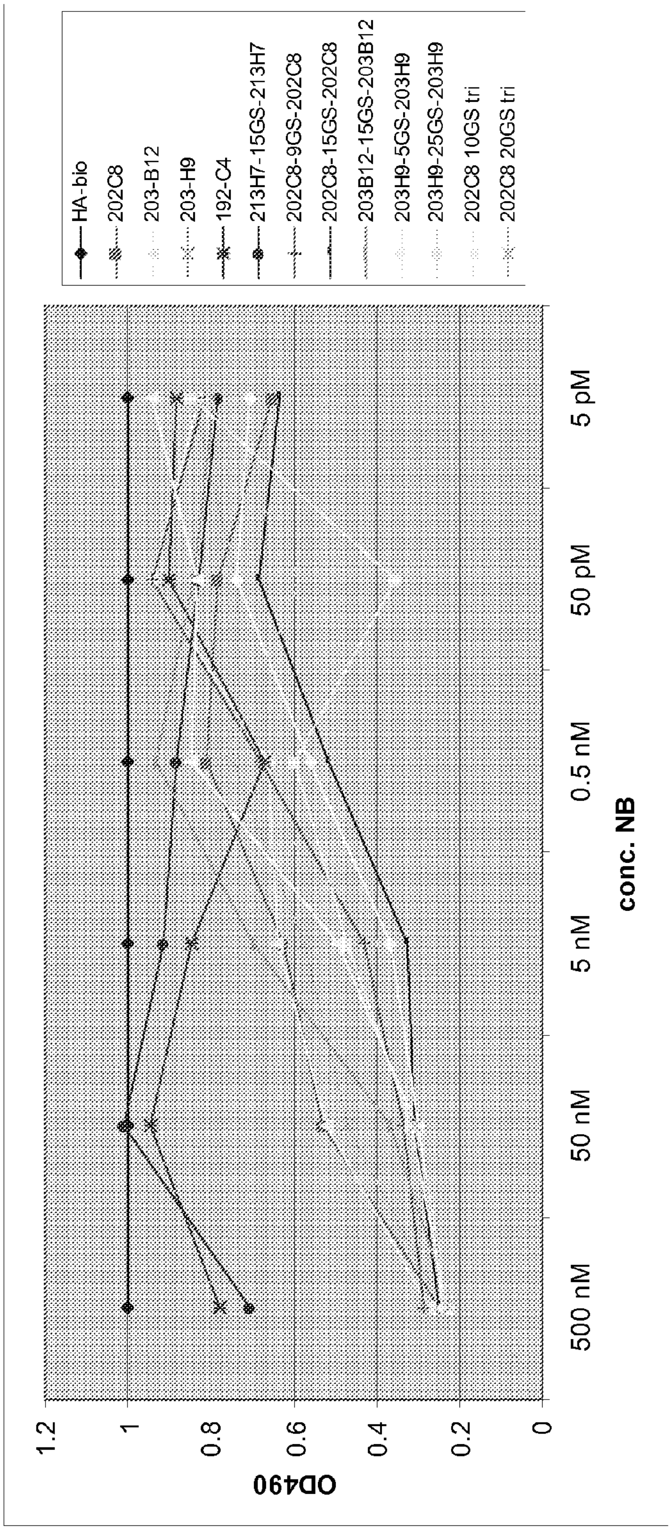
FIG. 35: Competition of purified multivalent NANOBODIES® ($V_{HH}$ sequences) with fetuin for binding to the hemagglutinin (H5) as described in Example 41.

Multivalent NANOBODIES® ($V_{HH}$ Sequences) Blocking the Interaction of H5 with Sialic Acid on Fetuin To investigate if the multivalent NANOBODIES® ($V_{HH}$ sequences) were able to block the interaction of H5 with sialic acid on fetuin, the same experimental set up was used as described in Example 13. Fetuin (from fetal calf serum, F2379, Sigma-Aldrich) was coated (10 μg/ml) in a maxisorb 96 well plate and incubated over night at 4° C. The plate was blocked in 2% BSA and then 0.7 μg/ml biotinylated HA (HA-bio) and different dilutions of purified multivalent NANOBODIES® ($V_{HH}$ sequences) were added for competition, diluted 1/10, starting with 500 nM. After incubation for 1 hour, HRP conjugated streptavidin was added and incubated for 1 hour. Binding specificity of HA-bio not recognized by purified multivalent NANOBODIES® ($V_{HH}$ sequences) was determined based on OD values compared to controls having received control NANOBODIES® ($V_{HH}$ sequences) (192-C4 against HRSV and 213H7-15GS-213H7 against Rabies). Results of competition between the purified multivalent NANOBODIES® ($V_{HH}$ sequences) and fetuin for binding to HA-bio is shown in FIG. 35. The multivalent NANOBODY® ($V_{HH}$ sequence) clones showed increased competition compared to the monovalent which may indicate that the competing NANOBODIES® ($V_{HH}$ sequences) recognize the sialic acid binding site on the HA and that multivalent NANOBODIES® ($V_{HH}$ sequences) have an increased capacity to block this site.

Example 42

Pharmacokinetics of 191D3, ALX-0081 and RANKL008A in the Male Wistar Rat after Single Intratracheal or Intravenous Administration 42.1

Test Items

Test items are described in Table C-12.

42.2

Methods

Animal Model 101 male Wistar rats (approximately 300 gram and 11 weeks old) were used for this study, a strain bred by Charles River Laboratories, Germany. The animals were held for at least 6 days for adaptation. Following the initial health check, the animals were weighed and allocated by means of a computerised randomisation program to the test groups; only healthy animals were used.

The sterile test substances were thawed in a water bath at 25° C. while swirling gently for 10 minutes. For intratracheal dosing, no further dilutions were required. For intravenous administration, the required amount of test substance was diluted in sterile DPBS ((Dulbecco's modified) Phosphate Buffered Saline) down to the desired concentrations. The test item formulations were freshly prepared within 4 hours prior to dosing.

Dose and Route of Administration

The different test groups and the dose levels are given in Table C-13. The i.v. bolus dose was given into a tail vein. The amount of test item for i.v. administration was adjusted to each animal's current body weight. The i.t. dose was administered intratracheally with a syringe with a blunt stainless steel dosing needle, after deep anaesthetization with isoflurane. The amount of test item for i.t. administration was set to 100 μL/animal, irrespective of body weight. Based on the actual body weights of the animals, an approximate dose in mg/kg could be calculated from the averaged body weights for comparison with the i.v. route: 4 mg/kg for RSV NB2, 5 mg/kg for ALX-0081 and 5 mg/kg for RANKL008a.

The average body weight of intratraceally dosed animals was on average 0.315 kg (RSV NB2 group), 0.317 kg (ALX-0081 group), 0.323 kg (RANKL008a group). As these animals received a fixed dosing of 100 μL/animal, the corresponding mean dose per b.w. were calculated at 3.6 mg/kg (RSV NB2 group), 3.1 mg/kg (ALX-0081 group), 3.2 mg/kg (RANKL008a group).

Blood and BALF Sampling and Processing.

After i.v. dosing, blood was sampled (approximately 300 μL) at 0.05, 0.25, 0.5, 1, 2, 4, 6, and 24 hours from the tail vein of RSV NB2- and ALX-0081-dosed animals and at 0.05, 0.25, 0.5, 1, 2, 4, 8, 24, and 48 hours from RANKL008a-dosed animals. All blood samples were placed on melting ice. Within approximately 30 minutes after sampling, the blood samples were centrifuged at 5° C. for 10 minutes (1500 g). Citrated plasma was stored in polypropylene tubes at approximately ≤−75° C. until dispatch on dry ice to the Sponsor.

After intratracheal dosing, blood, lungs, and BALF were collected (at necropsy following deep anaesthesia with isoflurane) at 0.05, 0.333, 1, 2, 4, 6, and 24 hours from RSV NB2-dosed rats and ALX-0081-dosed rats and at 0.05, 0.333, 1, 2, 4, 8 and 24 hours from animals dosed with RANKL008a. By means of an aorta punction 4 mL of blood was withdrawn. Within 42 minutes after sampling, the blood samples were centrifuged at 5° C. for 10 minutes (1500 g). Citrated plasma was stored in polypropylene tubes at approximately ≤−75° C. until dispatch on dry ice to the Sponsor. Following the removal of blood, lungs were harvested. First, the lungs including trachea were rinsed with iced DPBS and weighed. Then, BALF was collected. Five mL lavage fluid (DPBS) was carefully put into the lungs. After approximately 10 seconds, as much fluid as possible was returned to the syringe. BALF was transferred to an empty tube and directly stored on melting ice. This procedure was repeated. The second collection of BALF was added to the first collection. The volume of BALF that was collected was documented and reported. Subsequently, BALF was stored at approximately ≤−75° C. until dispatch on dry ice to the Sponsor.

Determination of RSV NB2 in Rat Plasma or BALF 96-well microtiter plates (Maxisorp, Nunc, Wiesbaden, Germany) were coated overnight at 4° C. with 100 μl hRSV (12.5 μg/mL, Hytest. Turku, Finland). Thereafter wells were aspirated, blocked (RT, 1 h, PBS-0.1% casein) and washed. The standards, QC, and predilutions of the test samples were prepared in a non-coated (polypropylene) plate in 100% rat plasma or BALF and incubated for 30 min at RT while shaking at 600 rpm. A 1/10 dilution of the samples in PBS-0.1% casein (final concentration of rat plasma or BALF is 10%) was transferred to the coated plate and incubated for 1 hr at RT while shaking at 600 rpm. After three washing steps with PBS-0.05% Tween20, the plates were incubated with polyclonal rabbit anti-NANOBODY® ($V_{HH}$ sequence) monoclonal K1 (1/2000 in PBS-0.1% casein, in-house) for 1 hr at RT while shaking at 600 rpm. After 3 washing steps with PBS-0.05% Tween20, 100 μl horseradish peroxidase (HRP) labeled polyclonal goat anti-rabbit (1/2000 in PBS-0.1% casein, DakoCytomation, Glostrup, Denmark) was incubated for 1 hr at RT while shaking at 600 rpm. Visualization was performed covered from light for 20 min with 100 μl 3,3',5,5'-tetramethylbenzidine (esTMB, SDT, diluted 1/3). After 20 min, the colouring reaction was stopped with 100 μl 1N HCl. The absorbance was determined at 450 nm, and corrected for background absorbance at 620 nm. Concentration in each sample was determined based on a sigmoidal standard curve. The lower limit of quantification (LLOQ) and upper limit of quantification (ULOQ) of the different assays are listed in Table C-14.

Determination of ALX-0081 in Rat Plasma or BALF 96-well microtiter plates (Maxisorp, Nunc) were coated overnight at 4° C. with 100 μl vWF in PBS (2.5 μg/mL, Haemate P1200/500—ZLB Behring). Thereafter wells were aspirated, blocked (RT, 1 h, PBS-0.1% casein) and washed. The standards, QC, and predilutions of the test samples were prepared in a non-coated (polypropylene) plate in 100% rat plasma or BALF and incubated for 30 min at RT while shaking at 600 rpm. A 1/5 dilution of the samples in PBS-0.1% casein (final concentration of rat plasma or BALF is 20%) was transferred to the coated plate and incubated for 1 hr at RT while shaking at 600 rpm. After three washing steps with PBS-0.05% Tween20, the plates were incubated with the anti-ALX0081 NB vWF12B2-G59-12B2-BIO (1 μg/ml in PBS-0.1% casein, in-house) for 30 min at RT while shaking at 600 rpm. After 3 washing steps with PBS-0.05% Tween20, 100 μl streptavidin-HRP (1/2000 in PBS-0.1% casein, DakoCytomation) was incubated for 30 min at RT while shaking at 600 rpm. Visualization was performed covered from light for 15 min with 100 μl 3,3',5,5'-tetramethylbenzidine (esTMB, SDT, diluted 1/3). After 15 min, the coloring reaction was stopped with 100 µl 1N HCl. The absorbance was determined at 450 nm, and corrected for background absorbance at 620 nm. Concentration in each sample was determined based on a sigmoidal standard curve. The LLOQ and ULOQ of the different assays are listed in Table C-15.

Determination of RANKL008a in rat plasma or BALE 96-well microtiter plates (Maxisorp, Nunc) were coated overnight at 4° C. with 100 µl neutravidin in PBS (2 µg/mL, Pierce, Rockford, Ill.). Wells were aspirated and blocked. After 3 washing steps with PBS-0.05% Tween20, biotinylated RANKL (0.5 µg/mL in PBS-0.1% casein) was captured by incubating 100 µl for 1 hr at RT while shaking at 600 rpm. After this incubation step, wells were washed. The standards, QC, and predilutions of the test samples were prepared in a non-coated (polypropylene) plate in 100% rat plasma or BALF and incubated for 30 min at RT while shaking at 600 rpm. A 1/10 dilution of the samples in PBS-0.1% casein (final concentration of rat plasma or BALF is 10%) was transferred to the coated plate and incubated for 1 hr at RT while shaking at 600 rpm. After three washing steps with PBS-0.05% Tween20, the plates were incubated with polyclonal rabbit anti-NANOBODY® ($V_{HH}$ sequence)monoclonal R23 (1/2000 in PBS-0.1% casein, in-house) for 1 hr at RT while shaking at 600 rpm. After 3 washing steps with PBS-0.05% Tween20, 100 µl horseradish peroxidase (HRP) labelled polyclonal goat anti-rabbit (1/5000 in PBS-0.1% casein, DakoCytomation, Glostrup, Denmark) was incubated for 1 hr at RT while shaking at 600 rpm. Visualization was performed covered from light for 10 min with 100 µL 3,3',5,5'-tetramethylbenzidine (esTMB, SDT, diluted 1/3). After 10 min, the coloring reaction was stopped with 100 µL 1N HCl. The absorbance was determined at 450 nm, and corrected for background absorbance at 620 nm. Concentration in each sample was determined based on a sigmoidal standard curve. The LLOQ and ULOQ of the different assays are listed in Table C-16.

Non-Compartmental Pharmacokinetic Data Analysis

Individual plasma and mean BALF concentration-time profiles of all rats were subjected to a non-compartmental pharmacokinetic analysis (NCA) using WinNonlin Professional Software Version 5.1 (Pharsight Corporation, Mountain View Calif., USA). The pre-programmed Models 200 and 201 were used to analyse the intratracheal and intravenous data, respectively. The linear-up/log down trapezoidal rule was used to calculate the area under the concentration-time data.

1.3

Results

Plasma Concentrations of RSV NB2, ALX-0081 and RANKL008a

Figure 36:
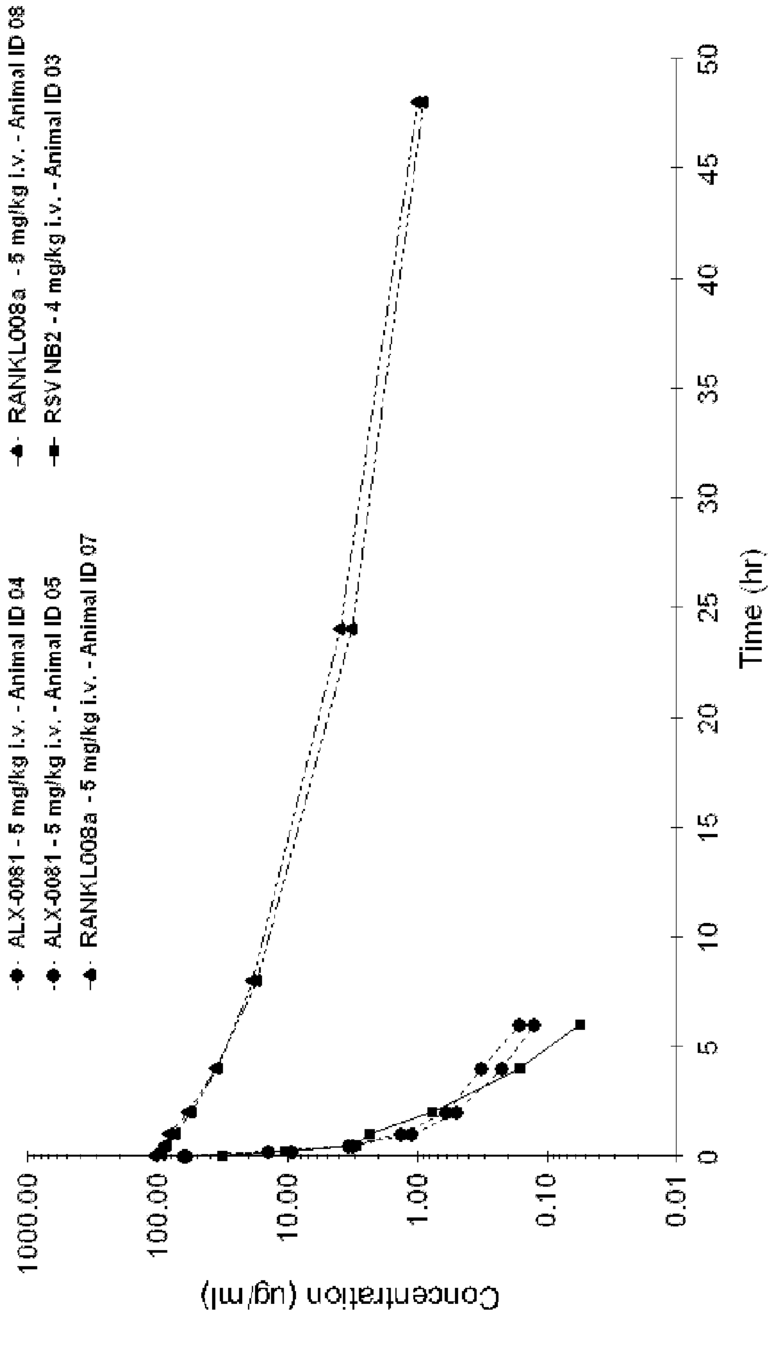
FIG. 36: Individual observed plasma concentration-time plot of RSV NB2, ALX-0081, and RANKL008a after a single i.v. bolus dose of RSV NB2 (4 mg/kg), ALX-0081 (5 mg/kg) and RANKL008a (5 mg/kg), respectively to male Wistar rats.
Figure 37:
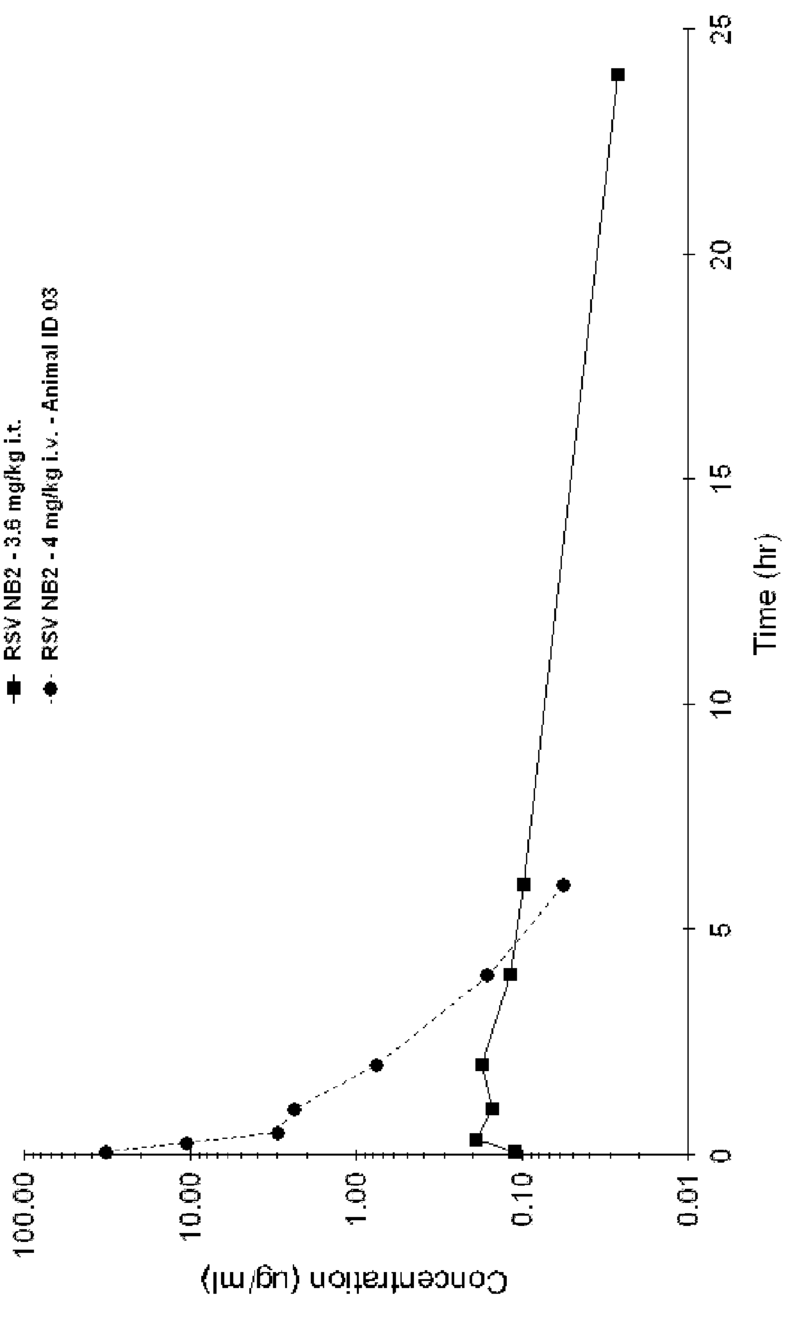
FIG. 37: Individual (i.v.) and mean (i.t.) observed plasma concentration-time plot of RSV NB2 (i.v. 4 mg/kg; i.t. 3.6 mg/kg and adjustment to 4 mg/kg).
Figure 38:
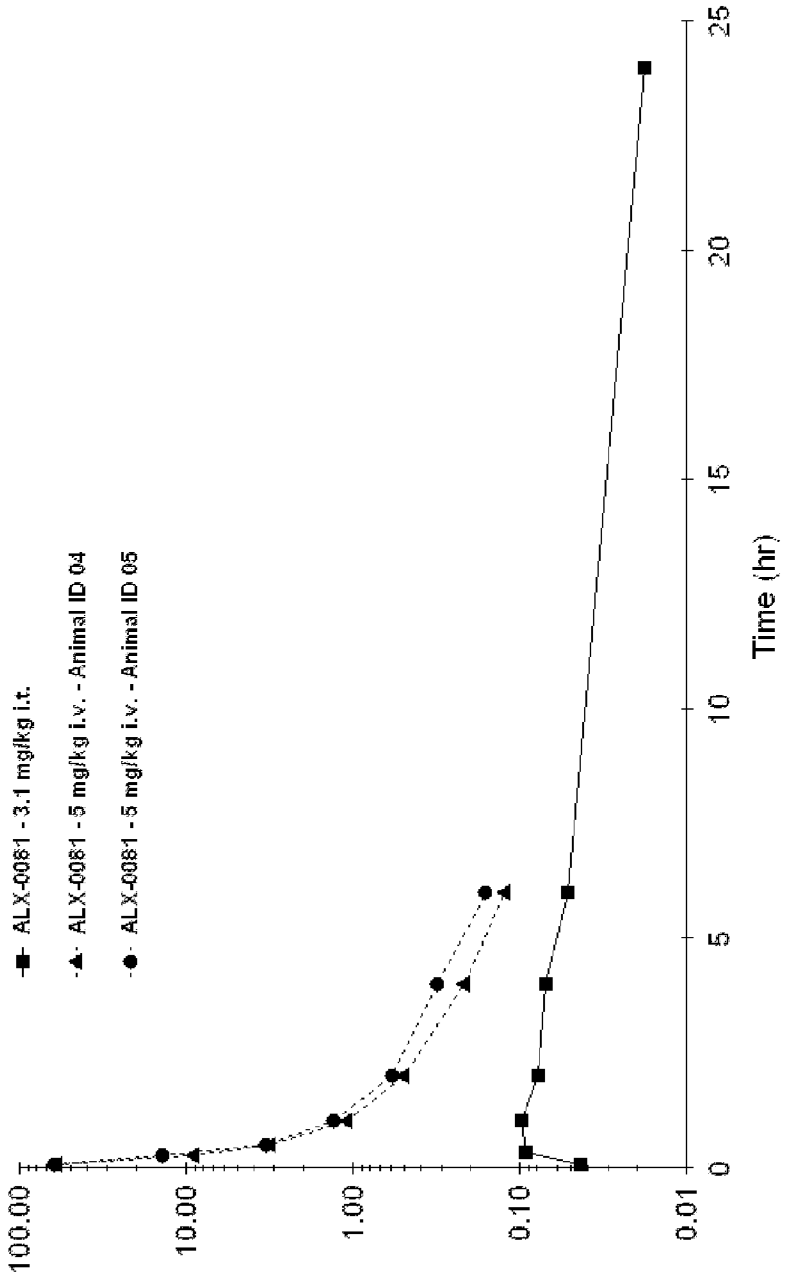
FIG. 38: Individual (i.v.) and mean (i.t.) observed plasma concentration-time plot of ALX-0081 (i.v. 5 mg/kg; i.t. 3.1 mg/kg and adjustment to 5 mg/kg).
Figure 39:
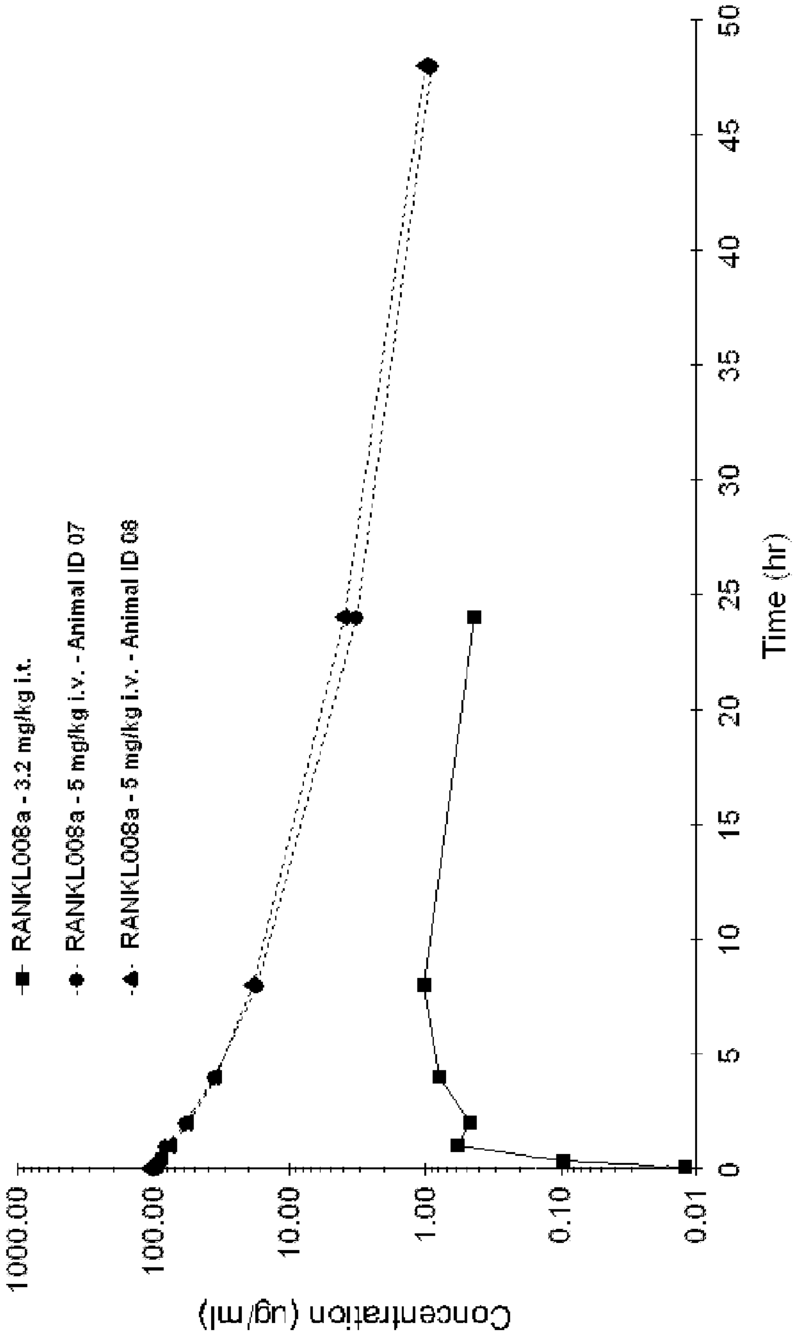
FIG. 39: Individual (i.v.) and mean (i.t.) observed plasma concentration-time plot of RANKL008a (i.v. 5 mg/kg; i.t. 3.2 mg/kg and adjustment to 5 mg/kg).

The observed plasma concentration-time data of the individual animals after a single i.v. administration and of the mean (n=4 animals/time-point; destructive sampling) plasma concentration-time data after a single i.t. administration of RSV NB2, ALX-0081, and RANKL008a are shown in FIGS. 36 (i.v; data for all compounds), 37 (RSV NB2 i.v. and i.t. data), 38 (ALX-0081 i.v. and i.t. data), and 39 (RANKL008a i.v. and i.t. data). The individual (i.v.) and both individual and mean plasma concentrations (i.t.) are listed in Tables C-17, C-18 and C-19, respectively.

Plasma Pharmacokinetic Analysis of RSV NB2, ALX-0081 and RANKL008a

An overview of the basic pharmacokinetic parameters obtained by non-compartmental PK analysis of RSV NB2 (4 mg/kg i.v. & 3.6 mg/kg i.t.), ALX-0081 (5 mg/kg i.v. & 3.1 mg/kg i.t.) and RANKL008a (5 mg/kg i.v. & 3.2 mg/kg i.t.) is given in Tables C-20, C-21 and C-22.

The PK parameters discussed herein were obtained using non-compartmental analysis (NCA). For rat 1 and 2 (RSV NB2 i.v.), rat 6 (ALX-0081 i.v.) and rat 9 (RANKL008a i.v.) difficulties in blood sampling occurred, and due to the limited data, these animals were excluded from subsequent pharmacokinetic calculations. The terminal parameters for some of the animals were calculated based on only two data-points in the terminal phase.

After i.v. administration of RSV NB2 4 mg/kg and ALX-0081 5 mg/kg comparable plasma PK profiles were observed (FIG. 36). This was also reflected in similar pharmacokinetic parameters for the monovalent RSV NB2 and bivalent ALX-0081. The mean clearance was estimated at 363 mL/hr/kg and 337 mL/hr/kg for RSV NB2- and ALX-0081-dosed rats. The corresponding mean Vss values were 250 mL/kg (RSV NB2) and 252 mL/kg (ALX-0081). The plasma concentrations of these NANOBODIES® ($V_{HH}$ sequences) were only detectable up to six hours (detection limit of 4 ng/mL for RSV NB2 and 3.75 ng/mL for ALX-0081) and the terminal half-lives were calculated at 0.926 hours for RSV NB2 and 2.06 hours for ALX-0081. For the trivalent RANKL008a administered intravenously (5 mg/kg), substantially lower mean clearance (9.00 mL/hr/kg) and Vdss values were calculated. The terminal half-lives were appreciably longer (12.6 hours). This is explained by the fact that RANKL008a is a half-life extended NANOBODY® ($V_{HH}$ sequence) (through binding of the ALB8 component) which is cross reactive with rat albumin, but with lower affinity relative to human serum albumin.

After i.t. administration of RSV NB2 (3.6 mg/kg), ALX-0081 (3.1 mg/kg) and RANKL008a (3.2 mg/kg), comparable terminal half-lives in the plasma were observed for the three NANOBODIES® ($V_{HH}$ sequences) (RSV NB2: 9.48 hr, ALX-0081: 10.5 hr and RANKL008a: 13.0 hr). For RSV NB2 and ALX-0081 the half-lives are longer after i.t. administration than after i.v. administration. It is conceivable that for these rapidly cleared compounds, the absorption is the rate limiting step resulting in flip-flop kinetics (i e kinetics are absorption rate controlled and the terminal phase is driven by the slow absorption from the site of administration (the lung) to the systemic circulation.

The exposure after i.t. administration was lower for all NANOBODIES® ($V_{HH}$ sequences) as compared to that after i.v. administration. This resulting bioavailabilities were 22.1%, 13.9%, and 6.9% for RSV NB2 (16.6 kD), ALX-0081 (27.9 kD), and RANKL008a (40.9 kD), respectively.

For lung topical applications (RSV NB2), a high pulmonary exposure is desired. It could be expected that a faster and more complete absorption (resulting in a higher bioavailability) would not benefit pulmonary exposure. Therefore, RSV NANOBODIES® ($V_{HH}$ sequences) with a higher molecular weight (f.e. a trivalent RSV NANOBODY® ($V_{HH}$ sequence)) could possibly lead to enhanced local (pulmonary) exposures.

The current data indicate that systemic exposure to NANOBODIES® ($V_{HH}$ sequences) can be achieved after intratracheal administration, suggesting that the pulmonary route may be viable as non-invasive method of delivery of NANOBODIES® ($V_{HH}$ sequences). Notably, the use of specific delivery formulations and/or devices could significantly improve bioavailability after pulmonary application. It is suggested that the bioavailability may be improved around 5 times (i.t. vs aerosol—see e.g. table 2 in Patton J., Fishburn S., Weers J. 2004, The Lung as a Portal of Entry for Systemic Drug Delivery. Proc. Am. Thorac. Soc. 1: 338-344).

BALF Concentrations of RSV NB2, ALX-0081 and RANKL008a

Figure 40:
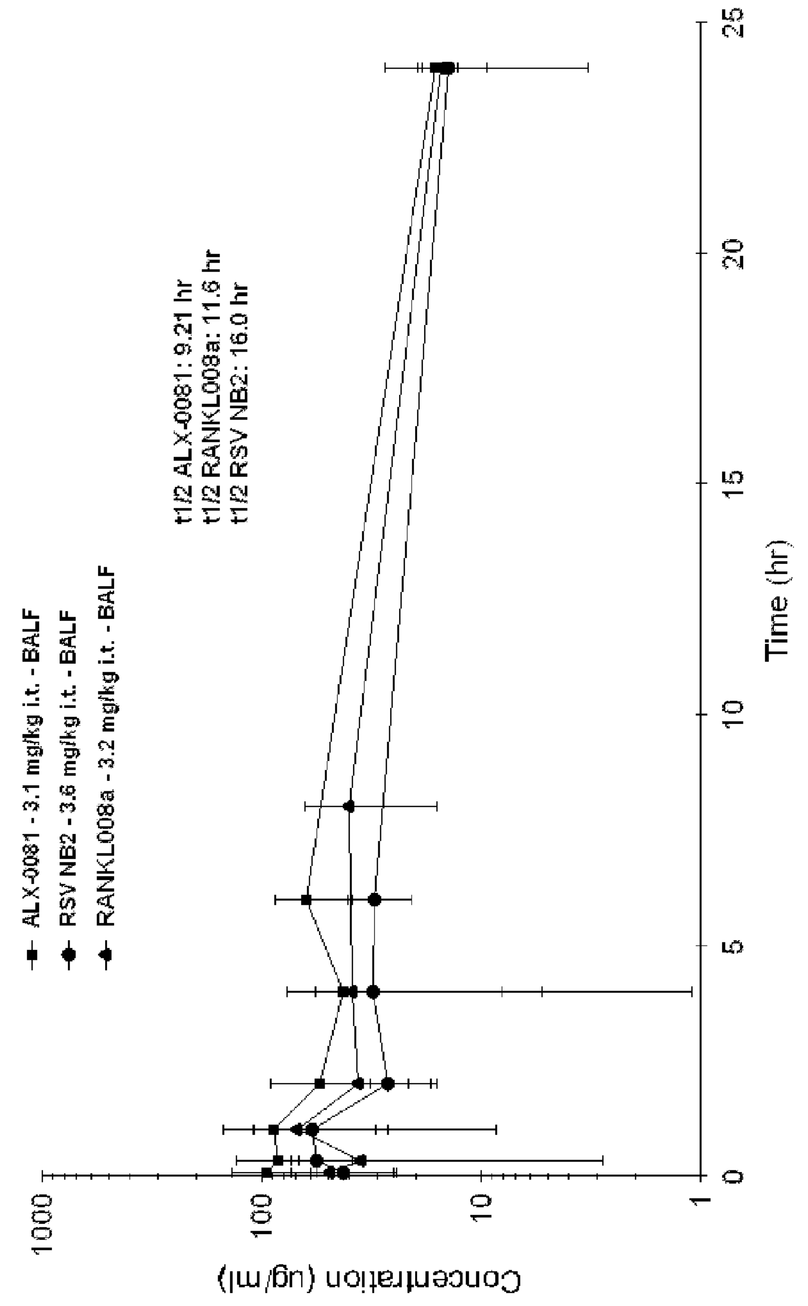
FIG. 40: Mean (+SD) observed BALF concentration-time profiles of RSV NB2, ALX-0081, and RANKL008a after a single intratracheal administration of RSV NB2 (3.6 mg/kg), ALX-0081 (3.1 mg/kg) and RANKL008a (3.2 mg/kg) to male rats.

The mean observed BALF concentration-time profiles after a single intratracheal administration of RSV NB2, ALX-0081 and RANKL008a to male rats is shown in FIG. 40. Individual and mean BALF concentrations are listed in Table C-23 and C-24, respectively.

The terminal half-lives of the three NANOBODIES® ($V_{HH}$ sequences) in BALF were based on the two last datapoints only. Of note is also that there was quite some inter-individual variability as indicated by the large standard deviations (see Table C-24). After i.t. administration, comparable terminal half-lives were observed in plasma (RSV NB2 9.48 hr, ALX-0081 10.5 hr and RANKL008a 13.0 hr) and in BALF (RSV NB2 16.0 hr, ALX-0081 9.21 hr and RANKL008a 11.6 hr), supporting the notion that the plasma kinetics are likely absorption rate controlled.

Following intratracheal administration, the RSV NB2, ALX-0081, RANKL008a NANOBODY® ($V_{HH}$ sequence) exposure in BALF was observed for at least 24 hours (i.e. the last sampling time for BALF).

Amounts of RSV NB2, ALX-0081 and RANKL008a in BALF

After intratracheal dosing broncho-alveolar lavage fluid (BALF) was collected at necropsy as described in detail earlier.

Theoretically, the amount of NANOBODY® ($V_{HH}$ sequence) in the lung at a given time-point can be obtained by multiplying the measured concentration of each BALF sample by the volume of DPBS added (10 mL), provided that the NANOBODY® ($V_{HH}$ sequence) is efficiently washed out. These individual calculated amounts and their corresponding mean (+SD) values are listed in Table C-25 and C-26, respectively.

Note however that large variations occurred in the recovery of the BALF. For some animals it was possible to recover 9.5 mL fluid after injecting 10 mL DPBS, while for other animals only 3 mL was recovered. Furthermore, since the lavage is performed twice and combined, in a single vial, it is impossible to determine how much volume was recovered from the first or second lavage separately. Moreover, it is also unknown whether there are differences in the concentration of the first and second lavage.

The result is that overestimations of the true amount of NANOBODY® ($V_{HH}$ sequence) may occur when multiplying the measured BALF concentrations are simply multiplied with the theoretical volume of 10 mL DPBS.

Alternatively, if the amount of NANOBODY® ($V_{HH}$ sequence) is estimated by multiplying the measured concentration of each BALF sample by the actual recovered volume of BALF, this may result in underestimations of the actual amount of NANOBODY® ($V_{HH}$ sequence) in case significant amounts of NANOBODY® ($V_{HH}$ sequence) are present in unrecovered BALF.

Therefore, the true amount of NANOBODY® ($V_{HH}$ sequence) in BALF should theoretically be comprised between the amount calculated via the theoretical BALF volume or the actual BALF volume. It is important to note that the larger the recovered volume, the more accurate the calculations are expected to be. Since the average recovered volume is on average ca. 7 mL (Table C-27), both calculation methods should not provide very different results. The individual calculated amounts and mean (+SD) values based on actual recovered volumes are listed in Table C-28 and C-29, respectively.

By dividing the calculated amount of NANOBODY® ($V_{HH}$ sequence) by the actual amount dosed (RSV NB2: 1.14 mg, ALX-0081: 0.985 mg, RANKL008a: 1.03 mg), the recovered fraction of the dose was calculated. Expressed as a percentage, the dose normalized individual calculated amounts and their corresponding mean (+SD) values based on the theoretical BALF volume (10 mL) and actual recovered volumes are listed in Tables C-30 to C-33.

By dividing the calculated amount of NANOBODY® ($V_{HH}$ sequence) by the actual amount dosed, the recovered fraction of the dose could be compared across time: The highest mean amount to dose percentages via actual and theoretical volume are 35.7% and 49.5% for RSV NB2 (After 20 minutes), 74.0% and 98.3% for ALX-0081 (After 4 minutes) and 47.1% and 67.4% for RANKL008A (After 1 hour), respectively. Thus for ALX-0081 almost the total fraction of the dose could be recovered in the BALF, while for RSV NB2 and RANKL008a, the fraction was lower: approximately 50% of the dose. The highest individual amount to dose percentages via actual and theoretical volume are 76.6% and 117.3% for RSV NB2, 145% and 182% for ALX-0081 and 84.1% and 120% for RANKL008a at time-point 1 hour post-dose. As expected, the variability was appreciable.

After 24 hours, the fraction of the dose recovered in BALF was lower for all NANOBODIES® ($V_{HH}$ sequences) than at earlier time-points. The mean fraction recovered ranged from 12.4% to 16.5% via the theoretical volume and ranged from 8.46% to 12.5% via the actual volumes for the three tested NANOBODIES® ($V_{HH}$ sequences).

42.3

Conclusions

After i.v. administration to rats, similar PK characteristics were observed for RSV NB2 and ALX-0081. For RANKL008a, substantially lower clearance values and longer terminal half-lives were observed. This may be explained by binding of the anti-HSA NANOBODY® ($V_{HH}$ sequence) of RANKL008a to rat albumin.

The current data indicate that systemic exposure to NANOBODIES® ($V_{HH}$ sequences) can be achieved after intra-tracheal administration, suggesting that the pulmonary route may be viable as non-invasive method for the delivery of NANOBODIES® ($V_{HH}$ sequences). The limited data also suggested that the systemic bioavailability seems to decrease with increasing molecular weight.

After i.t. administration comparable terminal half-lives were observed for the three NANOBODIES® ($V_{HH}$ sequences). For RSV NB2 and ALX-0081 the half-lives are longer after i.t. administration than after i.v. administration, suggesting that that absorption is the rate limiting step because the drug is slowly absorbed from its site of dosing (i.e. the lung) to the circulation. Comparable terminal half-lives are observed both in plasma and in BALF. This observation further enhances the possibility that the kinetics could be absorption rate controlled.

Following intra-tracheal administration, the RSV NB2, ALX-0081, RANKL008a NANOBODY® ($V_{HH}$ sequence) exposure in BALF was observed for at least 24 hours (i.e. the last sampling time for BALF).

Following intra-tracheal administration, systemic exposure to the RSV NB2, ALX-0081 NANOBODY® ($V_{HH}$ sequence) in plasma was observed for at least 24 hours (i.e. the last sampling time of plasma after intra-tracheal administration. Following i.v. administration both of these NANOBODIES® ($V_{HH}$ sequences) without anti-HSA were no longer detectable at 24 hours.

Figure 41:
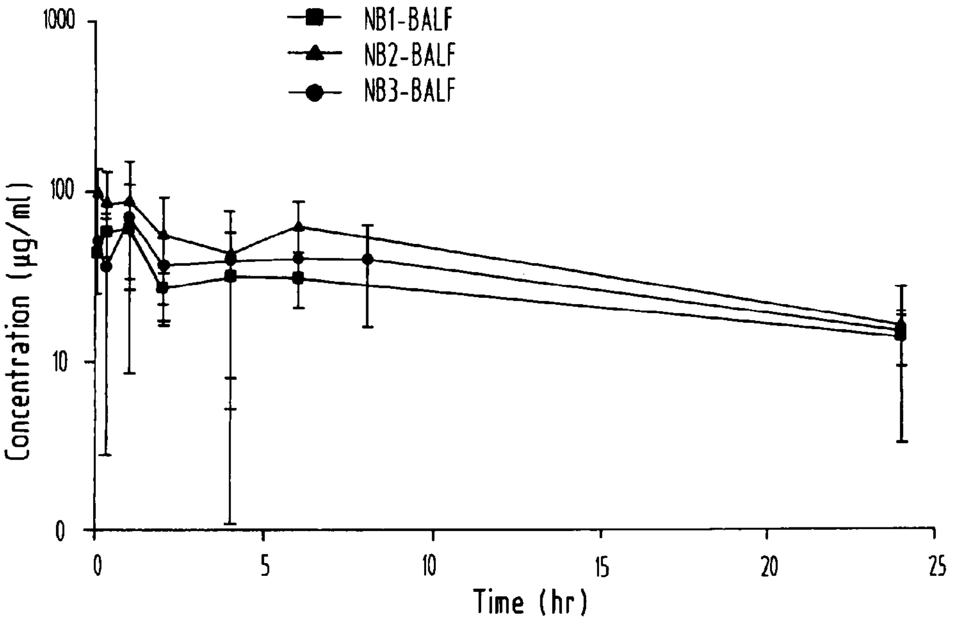
FIG. 41: Pulmonary delivered NANOBODIES® ($V_{HH}$ sequences) are stable in the lung for at least 24 hrs post-administration.

FIG. 41 and FIG. 42 further illustrate the experimental results.

Example 43

Further Studies with an Anti-RSV NANOBODY® ($V_{HH}$ Sequence) Construct

Example 43.1

Prophylactic Study with RSV407 in Cotton Rat

In this study cotton rats are treated either i.m. or intranasally with RSV neutralizing NANOBODY® ($V_{HH}$ sequence) constructs (RSV 407; SEQ ID NO: 2415) or control (PBS). Viral RSV challenge is administered intranasally 1 hour later. At day 4, animals are sacrificed and RSV titers determined by Q-PCR in nasal and lung washes as well as in nasal and lung tissue.

Example 43.2

Therapeutic Study with RSV407 in Cotton Rat

RSV therapeutic studies have been described in the past; e.g. by Crowe and colleagues (1994, Proc. Nat. Ac. Sci.; 91: 1386-1390) and Prince and colleagues (1987, Journal of Virology 61:1851-1854).

In this study cotton rats are intranasally infected with RSV. Twenty-four hours after infection a first group of animals are treated with RSV neutralizing NANOBODY® ($V_{HH}$ sequence) constructs (RSV 407) or control (PBS). Treatment is administered to pulmonary tissue by intranasal or aerosol administration. Treatment is repeated at 48 and 72 hours. At day 4 animals are sacrificed and RSV titers determined by Q-PCR in nasal and lung washed as well as in nasal and lung tissue.

In the second group, treatment is only initiated 3 days after infection and repeated at day 4 and 5. Finally, at day 6 animals are sacrificed and RSV titers determined by Q-PCR in nasal and lung washed as well as in nasal and lung tissue.

Example 43.3

Lung to Systemic

In this study the lung tissue of rats is exposed to an RSV neutralizing NANOBODY® ($V_{HH}$ sequence) (RSV407) by intratracheal or aerosol administration. Serum and BAL samples are taken at regular time points up to 3 days after administration. The NANOBODY® ($V_{HH}$ sequence) concentration is measured by means of ELISA and samples are subjected to RSV microneutralization as described in Example 15. By combining the information from the ELISA and the neutralization assay the RSV IC50 of each sample can be determined to assess systemic bioavailabilty of functional RSV NANOBODY® ($V_{HH}$ sequence).

Example 44

Screening Procedures, for Hep2 Cells Infected with RSV B-1

In addition to the identification of NANOBODIES® ($V_{HH}$ sequences) that are potent neutralizers of RSV Long strain in a microneutralization assay, NANOBODIES® ($V_{HH}$ sequences) can also be screened for their ability to neutralize RSV B-1. Clones obtained from selections against the F-protein and RSV, specifically from trypsin elutions, competitive elution with 101F Fab or with linear peptides (see Example 18), were subjected to an alternative screening procedure that included binding to the F-protein of RSV B-1.

As a first step, approximately 1000 periplasmatic extracts were analyzed for binding to $F_{TM}$-NN protein (1 μg/ml) in ELISA (see Example 20). On average, 44% of all clones were identified as binders (>2-fold over background), with 27% identified as strong binders (>3-fold). Only 10% of all binders originated from llamas 212 and 213.

Binders were subjected to a competition ELISA with Synagis® (67 pM) for binding to RSV Long (10 μg/ml; Hytest #8RSV79) to identify clones of epitope Class II. Detection of Synagis® was done using goat anti-human-HRP conjugated IgG (Jackson ImmunoResearch Laboratories, Inc., Cat. No. 109-035-098). This assay resulted in 9 hits (Table C-34).

In a similar manner, periplasmatic extracts were analyzed in a competition ELISA with 101F Fab to identify clones of epitope Class IV-VI (see Example 20). Detection was done using anti-HA monoclonal antibody (Zymed, 32-6700, 1389267), followed by anti-mouse-HRP conjugated antibody (Dako, Cat. No. P0260). Of the 90 competitors identified, the best 101F Fab competitors were further tested at dilutions ranging from 1/100-1/1000 to allow differentiation between clones (Table C-34).

As third step, the Class II and IV-VI epitope clones were analyzed for binding to Hep2 cells infected with RSV B-1 strains. In this assay, Hep2 cells were seeded into 96-wells plates and infected with an RSV B-1 strain, essentially following the procedure described for the neutralization assay (see Example 15). After three days the cells were fixed with ice-cold acetone and plates were used in an ELISA assay using periplasmic extracts at different dilutions. NANOBODY® ($V_{HH}$ sequence) binding to Hep2-B1 infected cells was detected using anti-VHH rabbit polyclonal antibody, followed by goat Anti-rabbit-HRP conjugated antibodies, after which the ELISA was developed according to standard procedures. In general, the Class II epitope clones proved weaker binders to Hep2-B1 cells than clones of the epitope Class IV-VI (Table C-34).

Sequence analysis reduced the total number of competing NANOBODIES® ($V_{HH}$ sequences). Clones 8A1 (SEQ ID NO: 249), 8B10 (SEQ ID NO: 342) and 1B2 (SEQ ID NO: 166) were found as multiple copies which were all ranked amongst the strongest binders to Hep2 B-1-infected cells. Clone 1B2 was identical to the sequence of the previous identified 191E4. The unique sequence 19E2 (SEQ ID NO: 301) belongs to the large family 4. From the group of Synagis® competitors, clones 19C4 (also referred to as 15H8; SEQ ID NO: 371) and 1G8 (SEQ ID NO: 2578) were the best RSV B-1 binders. Based on the binding to both RSV long and B-1, on sequence, and on 101F competition, a selection was made from 101F competitors for further analysis as purified proteins (Table C-34).

Example 45

Immunization of Llamas with Rabies Virus

Two llamas were immunised with rabies virus antigen and lymphocytes were collected as a source of virus-specific single-chain antibody mRNA. Immunised llamas had identification numbers 183 and 196, source: N.V. Neerhofdieren Bocholt, location: animal facilities of the Belgian Scientific Institute of Public Health (IPH, authorisation nr. LA1230177). All experimental procedures were approved by the Ethical Committee of the IPH and the Veterinary and Agrochemical Research Centre (VAR) (advice nr. 070515-04).

Inactivated Rabies Vaccine Merieux HDCV, marketed by Sanofi Pasteur MSD for use in humans, was the antigen. This vaccine contains the Wistar strain of the Pitman Moore virus grown on human diploid WI38 lung cells (PM/WI38 1503 3M). It contains human albumin, but no adjuvant. The vaccine was injected in the neck and the suspension divided over two spots (0.5 ml/spot) at day 0, 7, 28, 35, 57. Blood lymphocytes were collected on EDTA on day 42, 49 and 62 (Table C-35).

Both llamas developed protective titers of neutralizing antibodies in the range of 15-35 IU/ml. Lymphocytes were successfully collected from the blood. Lymph nodes were not distinguishably enlarged, which made them difficult to find. For this reason, lymph nodes were not used as a source of lymphocytes.

Example 46

In Vitro Neutralisation Potency of Monovalent NANOBODY® ($V_{HH}$ Sequence) Clones with the RFFIT Assay The neutralizing potency of NANOBODY® ($V_{HH}$ sequence) clones was determined and the most potent clones were selected to make bivalent and biparatopic combinations for further in vivo experiments. The clones were pre-selected by their capacity to bind to a substrate of purified glycoprotein G (Platelia II ELISA plates). Some of the selected clones competed with monoclonal antibody 8-2, which recognizes an epitope on the antigenic site IIa of the rabies surface glycoprotein G (Montaño-Hirose J A, Lafage M, Weber P, Badrane H, Tordo N, Lafon M. 1993, Protective activity of a murine monoclonal antibody against European bat lyssavirus 1 (EBL1) infection in mice. Vaccine 11: 1259-66).

The neutralizing potency of NANOBODY® ($V_{HH}$ sequence) or antibody preparations was determined with the Rapid Fluorescent Focus Inhibition Test (RFFIT). This test is a virus-neutralisation assay which uses Baby Hamster Kidney (BHK)-21 cells as susceptible targets. Infection of cells is visualized by staining with a fluorescein isothiocyanate (FITC)-coupled anti-nucleocapsid conjugate (Bio-Rad Laboratories, France). The virus strain used is the highly virulent and neurotropic Challenge Virus Standard (CVS)-11 (genotype 1 genus Lyssavirus, Family Rhabdoviridae). CVS-11 was obtained from the American Type Culture Collection (ATCC reference VR959). The in vitro neutralizing potency is expressed in International Units (IU)/m1 in reference to "The Second International standard for Anti-rabies Immunoglobulin" purchased from the United Kingdom National Institute for Biological Standards and Control. A serum titer of 0.5 IU/ml is considered protective in vivo. RFFIT was performed according to the Manual of Diagnostic Tests and Vaccines for Terrestrial Animals (Office International des Epizooties, 2008) and IS017052 norms (BELAC Accreditation 081-TEST). The results are shown in Table C-36.

The majority of NANOBODY® ($V_{HH}$ sequence) clones (15/16), which were isolated from the immunised llamas and selected based on their binding capacities to glycoprotein G, were neutralizing (0.50 IU/ml) in the RFFIT. In general, their potency was significantly lower compared to the reference monoclonal antibody (Mab) RV1C5 (0.17 nM $IC_{50}$). The clones with the strongest potency were 212-C12 (8 nM $IC_{50}$), 213-E6 (14 nM $IC_{50}$) and 212-F6 (18 nM $IC_{50}$). Control NANOBODIES® ($V_{HH}$ sequences), which were raised against another virus (human respiratory syncytial virus) or Toll-like receptor 3, were not neutralizing.

Example 47

Potency of Combinations of Monovalent Antibodies

The potency of a combination of two different monovalent NANOBODIES® ($V_{HH}$ sequences) (no linkage) and the synergistic effect on the neutralizing potency compared to the monovalent clones was investigated.

The neutralizing potency of combinations and single clones was determined by RFFIT. Competition binding experiments showed that clones 213-E6, 214-E8 and 213-H7 bind to the same major epitope on the glycoprotein G, whereas 212-C12 binds to a different major epitope. The results are shown in Table C-37.

All tested combinations of monovalent clones yielded no additive effect on the neutralizing potency. Synergistic effects were not observed even with clones which bind to different major epitopes.

Example 48

Cross-Neutralization of Selected Clones Against Divergent Genotype 1 and 5 Lyssa Virus Clones that were selected against the genotype 1 CVS-11 strain were examined for their ability to cross-neutralize other genotype 1 lyssaviruses (laboratory strains and street isolates; obtained from Prof. S. Van Gucht, Scientific Institute of Public Health, Rabies Laboratory, Brussels, Belgium).

Cross-neutralisation against a genotype 5 lyssavirus (European bat lyssavirus-1, EBLV-1; obtained from Prof. S. Van Gucht, Scientific Institute of Public Health, Rabies Laboratory, Brussels, Belgium) was also examined. Most human cases of rabies (>99%) are caused by genotype 1 lyssaviruses. EBLV-1 circulates in certain species of bats (mainly *Eptesicus serotinus*) in Europe.

Evelyn-Rotnycki-Abelseth (ERA) is an attenuated genotype 1 strain which is used as an oral vaccine for immunisation of wild life (ATCC reference VR322). Chien Beersel (CB)-1 is a virulent genotype 1 virus isolated from the brain of a rabid dog which was imported from Morocco to Belgium (Le Roux I. and Van Gucht S. 2008. Two cases of imported canine rabies in the Brussels area within six months time. WHO Rabies Bulletin 32(1), Quarter 1). The EBLV-1 strain 8919FRA belongs to genotype 5 and was isolated from an *Eptesicus serotinus* bat in France (Bourhy et al. 1992. Antigenic and molecular characterization of bat rabies virus in Europe. J Clin Microbiol. 30(9):2419-26). The strain was provided by Dr. L. Dacheux form the Pasteur Institute of Paris (MTA DB/EB-08/420). The viral stocks were grown in BHK-21 cells, except for CB-1 which was grown in neuroblastoma N2a cells. The lysates of infected cell cultures were centrifuged at 20000×g for 20 minutes at 4° C. and supernatants were stored at −80° C.

In addition, 7 genotype 1 strains were provided by Dr. L. Dacheux from the Pasteur Institute of Paris in the form of infected mouse brains. Six strains were wild isolates, among which an isolate from a dog from Cambodia (9912CBG, accession nr.
EU086169/EU086132), a fox from France (9147FRA, accession nr. EU293115), a raccoon dog from Poland 9722POL), a human patient from Thailand (8740THA), a dog from the Ivory Coast (07059IC, accession nr. EU853615/FJ545659)

and a dog from Niger (9009NIG, accession nr. EU853646). One brain was infected with the laboratory CVS IP13 strain.

The neutralizing potency against ERA, CB-1 and EBVL-1 was determined in an RFFIT adapted with the virus of interest. Neutralisation was defined as a minimal neutralizing potency of 0.50 Equivalent Units (EU)/ml.

For the infected brains, an alternative neutralisation assay was developed. Briefly, ten-fold dilutions of the infected brain suspensions were pre-incubated with a 1/50 dilution of the stock solution of NANOBODY® ($V_{HH}$ sequence) for 90 minutes at 37° C. and 5% $CO_2$. Then, susceptible neuroblastoma N2a cells were added to the mix. Two days later, infection of the cells was measured by staining with a FITC-coupled anti-nucleocapsid conjugate (Bio-Rad Laboratories, France). Neutralisation was defined as a minimum hundred-fold reduction of the infectious titer in comparison to an irrelevant NANOBODY® ($V_{HH}$ sequence) control (172-B3 anti-TLR3).

Results are shown in Table C-38 (ERA), Table C-39 (CB-1), Table C-40 (EBLV-1) and Table C-41 (infected brain). Table C-42 gives an overview of the neutralisation profile of all tested clones.

In general, most clones which neutralized the prototype CVS-11 strain also neutralized most other genotype 1 viruses. An exception is clone 212-C12, which proved to be a relative potent neutralizer of CVS-11, but did not neutralize 3 out of 9 other genotype 1 strains. 214-F8 neutralized all 10 genotype 1 strains. 213-E6 neutralized 9 out of 10 genotype 1 strains and 213-H7 neutralized 8 out of 10 genotype 1 strains. Attention should be drawn to the fact that for 213-E6 and 213-H7 a relative low amount of NANOBODY® ($V_{HH}$ sequence) was used in the assay (respectively 0.1 and $1.7\times10^{-3}$ IU). Neutralisation might have been complete if higher amounts had been used. Seven of the sixteen anti-rabies clones, including clones 213-H7 and 214-E8, were also able to neutralize the divergent EBLV-1 strain. This indicates that the epitope recognized by these clones is highly conserved among lyssaviruses.

Example 49

Potency of Bivalent and Biparatopic NANOBODY® ($V_{HH}$ Sequence) Combinations Measured with the RFFIT Assay The potential synergistic effect on the neutralizing potency of the linkage of two similar (bivalent) or different (biparatopic) NANOBODIES® ($V_{HH}$ sequences) compared with the monovalent clones was investigated.

The neutralizing potency of bivalent and biparatopic clones was determined using RFFIT as described above. Different fusion proteins were developed with 3 Gly-Ser linkers: 5GS, 15GS or 25GS. Sequences of multivalent NANOBODY® ($V_{HH}$ sequence) constructs against rabies are given in Table A-6. NB6-18GS-NB6 (RSV115; SEQ ID NO: 2394) is a control bivalent NANOBODY® ($V_{HH}$ sequence) which was raised against another virus (human respiratory syncytial virus). Data on neutralization of EBLV-1 strain is shown in Table C-40. Data on neutralization of wild type genotype 1 strains and a laboratory CVS strain in suspensions of infected mouse brain is shown in Table C-41. Table C-42 gives an overview of the neutralisation profile of all tested clones. The results of neutralization of CVS-11 are shown in Table C-43.

The majority of the tested bivalent and biparatopic NANOBODIES® ($V_{HH}$ sequences) had a significantly higher potency than the corresponding monovalent clones. For example, the biparatopic combination 214E8-15GS-213H7 was 600-fold more potent that the monovalent NANOBODIES® ($V_{HH}$ sequences). In general, the bivalent combinations seemed less potent than the biparatopic combinations. The most potent bivalent combinations had a neutralizing potency between 15 and 36 IU/nM (213H7-15GS-213H7, 213E6-5GS-213E6, 214F8-15GS-214F8). For the most potent biparatopic combinations, this ranges between 80 and 230 IU/nM (213E6-15GS-213H7, 213H7-15GS-214F8, 214E8-15GS-213H7). This is comparable to the neutralizing potency of the anti-rabies monoclonal antibody RV1C5 (Santa Cruz) (194 IU/nM). Most of the potent combinations had a 15GS linker.

Example 50

In Vivo Neutralisation of Virulent CVS-11 with Monovalent/Bivalent NANOBODIES® ($V_{HH}$ Sequences) Using the Brain as the Susceptible Target System: Intracerebral Inoculation in Mice

50.1

In Vivo Neutralization by Monovalent NANOBODIES® ($V_{HH}$ Sequences)

Whether NANOBODIES® ($V_{HH}$ sequences) (monovalent, bivalent or biparatopic), which proved to be potent neutralizers in vitro, can also neutralize the virus in vivo and prevent lethal infection of the brain was investigated. Outbred Swiss mice (5-6 weeks old) were inoculated intracerebrally with rabies virus CVS-11 pre-incubated with 1 IU of NANOBODY® ($V_{HH}$ sequence), 1 IU of monoclonal antibody (mab 8-2) or PBS (negative control) (6 to 9 mice/group). Prior to inoculation, the mix of virus and NANOBODY® ($V_{HH}$ sequence) or antibody was incubated at 37° C., 5% $CO_2$ for 30 min. A volume of 20 μl (10 μl virus+10 μl NANOBODY® ($V_{HH}$ sequence)) was inoculated into the brain by transcranial introduction of a 26G needle. Neutralizing units (IU) were determined using the in vitro RFFIT assay. A viral dose of $10^{1.5}$ $TCID_{50}$/mouse was used based on preliminary experiments with different doses of virus preincubated with 1 IU of mab 8-2. This preliminary work indicated that a dose of 1 IU of mab 8-2 was able to protect all mice from lethal infection (0% mortality) upon intracerebral inoculation with $10^{1.5}$ $TCID_{50}$, which was not the case at higher virus doses ($10^2$ $TCID_{50}$ CVS+1 IU mab 8−2=43% mortality). Mice were examined for (rabies) disease signs each work day and a clinical score was given per day per mice. Clinical scores ranged from 0 (no disease signs) to 6 (weight loss, depression, hunched back, wasp waist, incoordination and hind limb paralysis). At score 6, mice were sacrificed by cervical dislocation. The experiment was ended at 28 days post inoculation (DPI).

Figure 43:
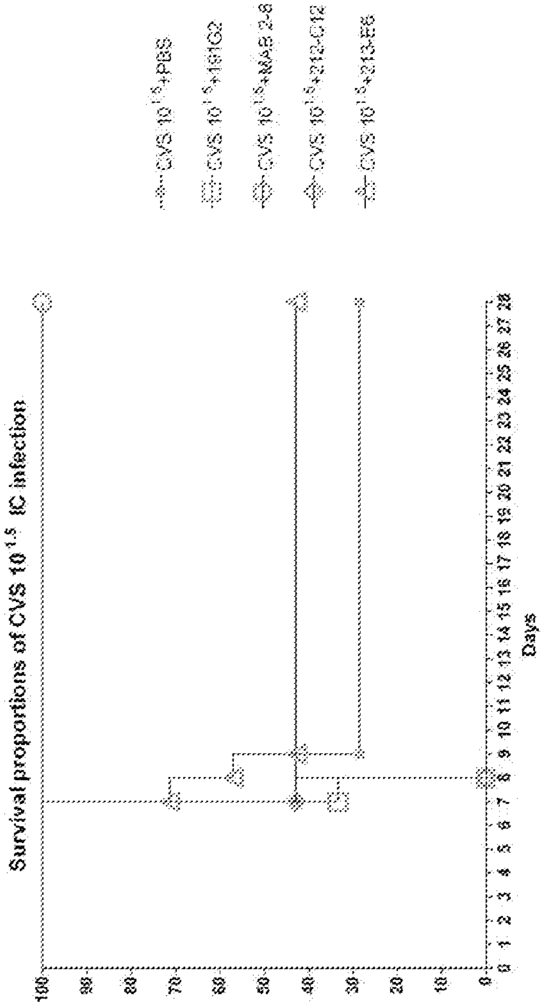
FIG. 43: Kaplan Meier curve showing the survival proportion of mice inoculated with a mix of virus and monovalent anti-rabies NANOBODY® ($V_{HH}$ sequence) (212-C12 and 213-E6). Control mice were inoculated with a mix of virus and PBS, mab 8-2 or irrelevant NANOBODY® ($V_{HH}$ sequence) (191-G2=anti-human respiratory syncytial virus).

The results for monovalent antibodies are shown in FIG. 43 and Table C-44. The peak clinical score and the mean time of death of the NANOBODY® ($V_{HH}$ sequence) groups were not significantly different from the control groups, in contrast to the monoclonal antibody group (P<0.01, one-way ANOVA with Dunnett's post-Test).

The monoclonal antibody (mab 8-2) provided full protection against an intracerebral challenge with $10^{1.5}$ $TCID_{50}$ CVS-11. Pre-incubation with an irrelevant NANOBODY® ($V_{HH}$ sequence) (191-G2) did not protect the mice from lethal infection (100% mortality). Mice which were inoculated with the virus alone developed 71% mortality. The fact that mortality was higher with the irrelevant NANOBODY® ($V_{HH}$ sequence) was probably a coincidence and not due to a potentially harmful effect of the NANOBODY® ($V_{HH}$ sequence). In preliminary experiments, mice which received NANOBODY® ($V_{HH}$ sequence) alone did not develop signs of disease. Also, the clinical course of the mice which received virus+irrelevant NANOBODY® ($V_{HH}$ sequence) resembled the typical rabies pattern. The anti-rabies NANOBODY® ($V_{HH}$ sequence) 213-E6 provided a partial protection against the rabies virus with a mortality of 57%. The Kaplan Meier survival curve of 213-E6 resembles a typical “staircase” profile similar to that of the survival curve with monoclonal antibody at higher virus concentrations. Remarkably, anti-rabies NANOBODY® ($V_{HH}$ sequence) 212-C12 did not protect (100% mortality) in vivo, although this was one of the most potent clones in vitro with BHK cells as the susceptible targets.

This experiment demonstrates that partial protection can be achieved with monovalent NANOBODY® ($V_{HH}$ sequence) in the intracerebral challenge model. The in vitro and in vivo potencies are poorly correlated. Although the NANOBODIES® ($V_{HH}$ sequences) and antibody were used at the same in vitro dose of 1 IU, their in vivo potency was clearly different (mab 8-2>213-E6>212-C12).

50.2

In Vivo Neutralization by Bivalent NANOBODIES® ($V_{HH}$ Sequences)

Figure 44:
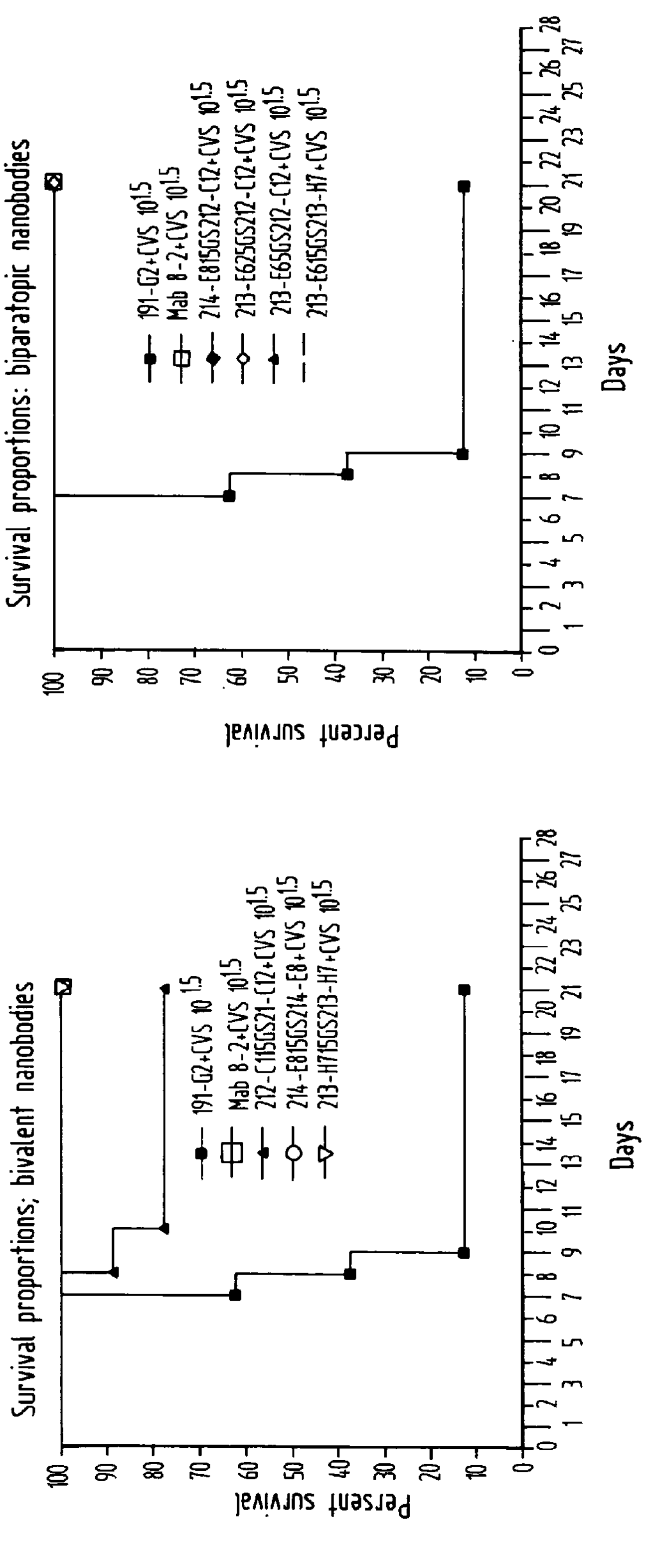
FIG. 44: Kaplan Meier curve showing the survival proportion of mice inoculated with a mix of virus and bivalent/biparatopic NANOBODY® ($V_{HH}$ sequence). Control mice were inoculated with a mix of virus and mab 8-2 or an irrelevant NANOBODY® ($V_{HH}$ sequence) (191-G2=anti-human respiratory syncytial virus).

Bihead NANOBODIES® ($V_{HH}$ sequences) were tested using the same intracerebral challenge model. The results for bivalent and biparatopic antibodies are shown in FIG. 44 and Table C-45. The peak clinical score (P<0.01) and the mean time of death (P<0.05) of the bihead (bivalent and biparatopic) NANOBODY® ($V_{HH}$ sequence) groups were significantly different from those of the 191-G2 control group (one-way ANOVA with Dunnett’s post-Test).

As in the previous experiment, the monoclonal antibody 8.2 provided full protection against an intracerebral challenge with $10^{1.5}$ $TCID_{50}$ CVS-11, whereas high mortality (87.5%) was observed after pre-incubation with an irrelevant NANOBODY® ($V_{HH}$ sequence) (191-G2). The bivalent combinations 214E8-15GS-214E8 and 213H7-15GS-213H7 and all biparatopic combinations yielded complete protection against the intracerebral rabies virus challenge (0% mortality). The bivalent combination 212C12-15GS-212C12 yielded now clear partial protection (22.2% mortality). Based on the mortality data with both monovalent and bivalent 212-C12, it is likely that the epitope which is recognized by this clone is less suited for neutralisation in brain than in vitro.

Figure 48:
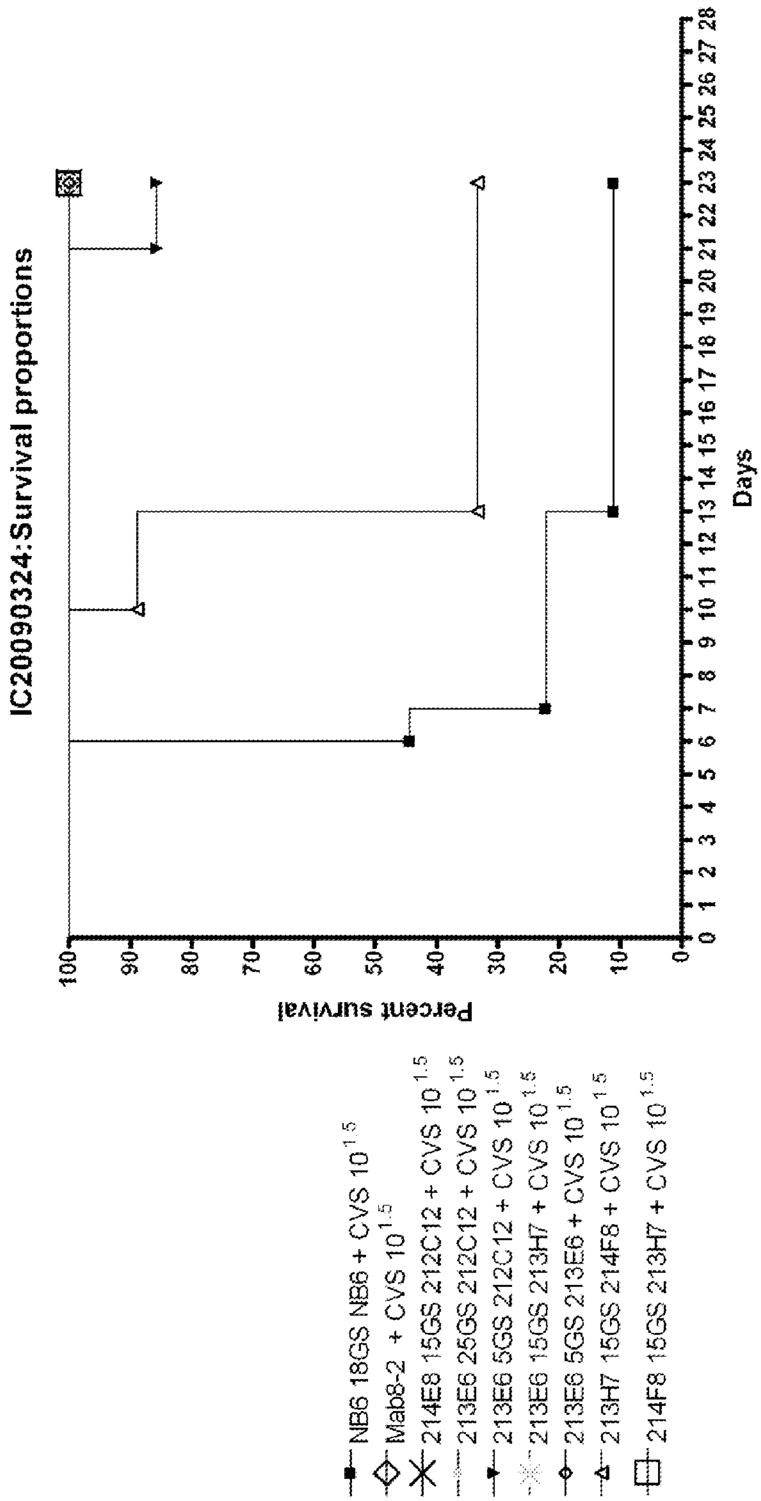
FIG. 48: Kaplan Meier curve showing the survival proportion of mice inoculated with a mixture of virus and bivalent/biparatopic NANOBODY® ($V_{HH}$ sequence). Control mice were inoculated with a mix of virus and Mab 8-2 or an irrelevant NANOBODY® ($V_{HH}$ sequence) (RSV115; SEQ ID NO: 2367).

Results of a further experiment with bivalent and biapratopic NANOBODIES® ($V_{HH}$ sequences) are shown in FIG. 48 and in Table C-48. 214-E8-15GS-212-C12, 213E6-25GS-212-C12, 213-E6-15GS-13H7 induced 100% of protection. 213-E6-5GS-212-C12 presented a weak mortality (14.3%) very later during this experiment (FAT was very lighty positif). 213-E6-5GS-213-E6 and 214-E8-15GS 213-E6 induce a total protection while 213-E6-15GS-214-E8 induced only a partial one.

The combination of NANOBODIES® ($V_{HH}$ sequences) in a bivalent or biparatopic conformation induces a synergistic increase of both the in vitro and in vivo potencies. A same in vitro dose of 1 IU is much more effective in the bivalent/biparatopic conformation than in the monovalent conformation.

This experiment presents data from day 0-21. We expect that there will be no further changes in clinical signs or mortality in day 21-28.

50.3

Detection of Virus in Mouse Brains

The brains of the mice inoculated with $10^{1.5}$ $TCID_{50}$ CVS-11 mixed with an anti-rabies NANOBODY® ($V_{HH}$ sequence) (1 IU 213-E6) were stained for the presence of viral antigens. Acetone-fixed brain smears were subjected to immunofluorescence staining with an FITC-conjugated anti-nucleoprotein antibody (FAT).

Figure 51:
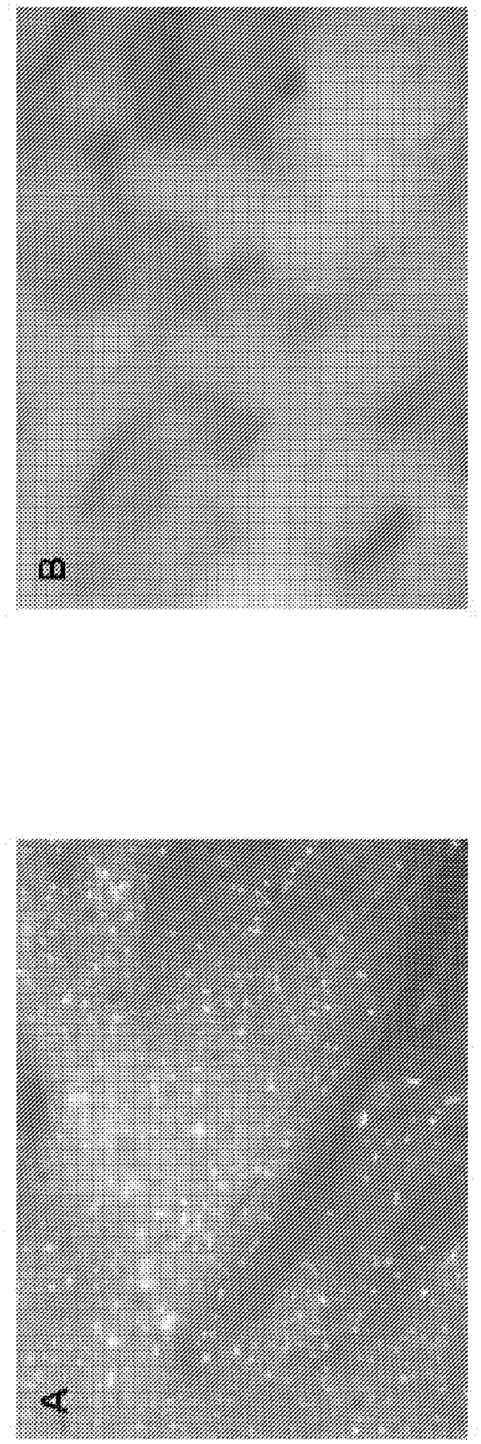
FIG. 51: Immunofluorescence staining of acetone-fixed brain smears of mice inoculated with $10^{1.5}$ $TCID_{50}$ CVS-11 mixed with an anti-rabies NANOBODY® ($V_{HH}$ sequence) (1 IU 213-E6). Staining was done with an FITC-conjugated anti-nucleoprotein antibody (FAT). A: brain of mouse at 7 DPI with $10^{1.5}$ $TCID_{50}$ CVS-11 mixed with an irrelevant NANOBODY® ($V_{HH}$ sequence) (192-G2); B: brain of mouse at 7 DPI with $10^{15}$ $TCID_{50}$ CVS-11 mixed with an anti-rabies NANOBODY® ($V_{HH}$ sequence) (1 IU 213-E6).

FIG. 51A demonstrates the abundant presence of viral antigens in the brain of a mouse at 7 DPI with $10^{1.5}$ $TCID_{50}$ CVS-11 mixed with an irrelevant NANOBODY® ($V_{HH}$ sequence) (192-G2). The mouse had a clinical score of 6 at the time of euthanasia. FIG. 51B shows the absence of viral antigens in the brain of a mouse at 7 DPI with $10^{1.5}$ $TCID_{50}$ CVS-11 mixed with an anti-rabies NANOBODY® ($V_{HH}$ sequence) (1 IU 213-E6). The mouse presented no clinical disease signs at the time of euthanasia.

50.4

Intracerebral Inoculation of Mice with Dose of $10^2$ $TCID_{50}$

Most bivalent and biparatopic NANOBODIES® ($V_{HH}$ sequences) provide good protection against a viral dose of $10^{1.5}$ $TCID_{50}$. In this experiment, we examined whether the bivalent 213E6-15GS-213H7 also offers protection against a dose of $10^2$ $TCID_{50}$ CVS-11. Mab RV1C5 (anti-G $IgG_{2a}$, Santa Cruz sc-57995) was used as a control antibody.

Figure 52:
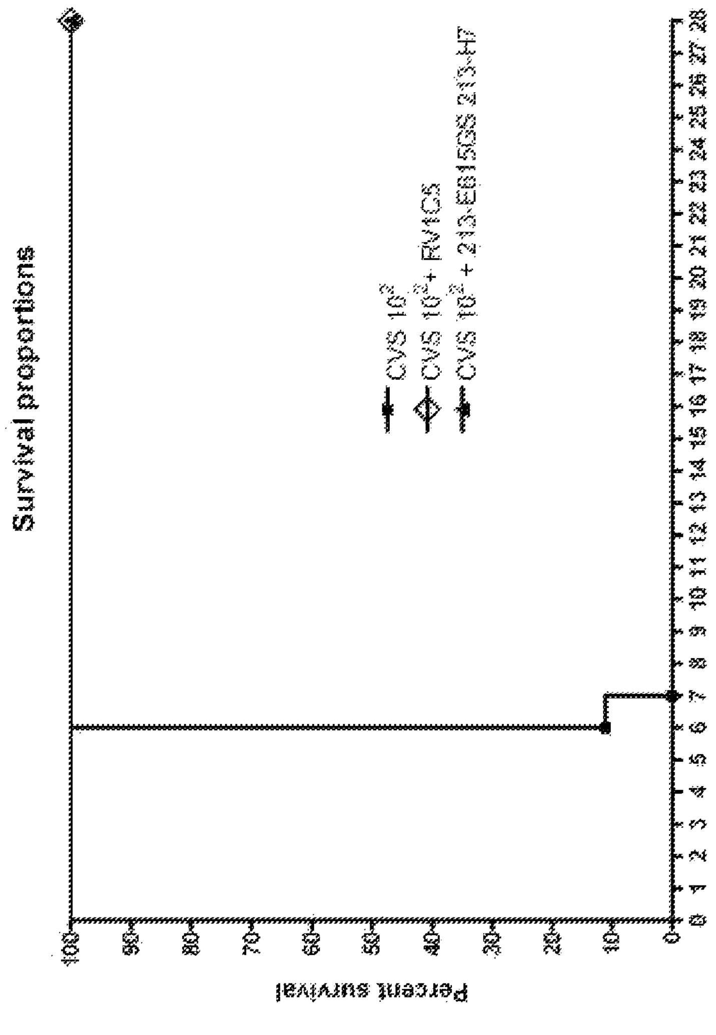
FIG. 52: Kaplan Meier curve showing the survival proportion of mice inoculated with a mix of $10^2$ $TCID_{50}$ virus and the biparatopic NANOBODY® ($V_{HH}$ sequence) 213E6-15GS-213H7 as described in Example 50.4. Control mice were inoculated with a mix of virus and mab RV1C5 or PBS.

Results are shown in Table C-49 and FIG. 52. Even at a higher viral dose of $10^2$ $TCID_{50}$, the bivalent combination 213E6-15GS-213H7 provided full protection, whereas in preliminary experiments (data not shown) 100% mortality was observed with the monovalent NANOBODIES® ($V_{HH}$ sequences) at the same viral dose. In a future experiment, we will test 213E6-15GS-213H7 with an even higher viral dose of $10^3$ $TCID_{50}$.

Example 51

In Vivo Protection of Mice by Intranasal Application of NANOBODY® ($V_{HH}$ Sequence)

Monovalent NANOBODIES® ($V_{HH}$ sequences) against rabies were tested in intranasal mice model. The NANOBODIES® ($V_{HH}$ sequences) were injected intranasally after preincubation with two different virus doses.

Outbred Swiss mice (5-6 weeks old) were inoculated intranasally with rabies virus CVS-11 pre-incubated with 1 IU of NANOBODY® ($V_{HH}$ sequence) or monoclonal antibody (mab 8-2). Prior to inoculation, the mix of virus and NANOBODY® ($V_{HH}$ sequence) or antibody was incubated at 37° C., 5% $CO_2$ for 30 min. Mice were first anesthetized with isoflurane and fixed with the head held up. A volume of 25 µl (12.5 µl virus+12.5 µl NANOBODY® ($V_{HH}$ sequence)) was inoculated on top of the nostrils with a micropipette. Immediately after application, the inoculum is inhaled in the nose through the rapid and superficial breathing of the anesthetized animal. A viral dose of $10^3$ (IN20090310) or $10^2$ $TCID_{50}$ (IN20090210, IN20090414) was used. Mice were examined for (rabies) disease signs each work day and a clinical score was given per day per mice. Clinical scores ranged from 0 (no disease signs) to 6 (weight loss, depression, hunched back, wasp waist, incoordination and hind limb paralysis). At score 6, mice were sacrificed by cervical dislocation. The experiment ends at 35 DPI.

Figure 47:
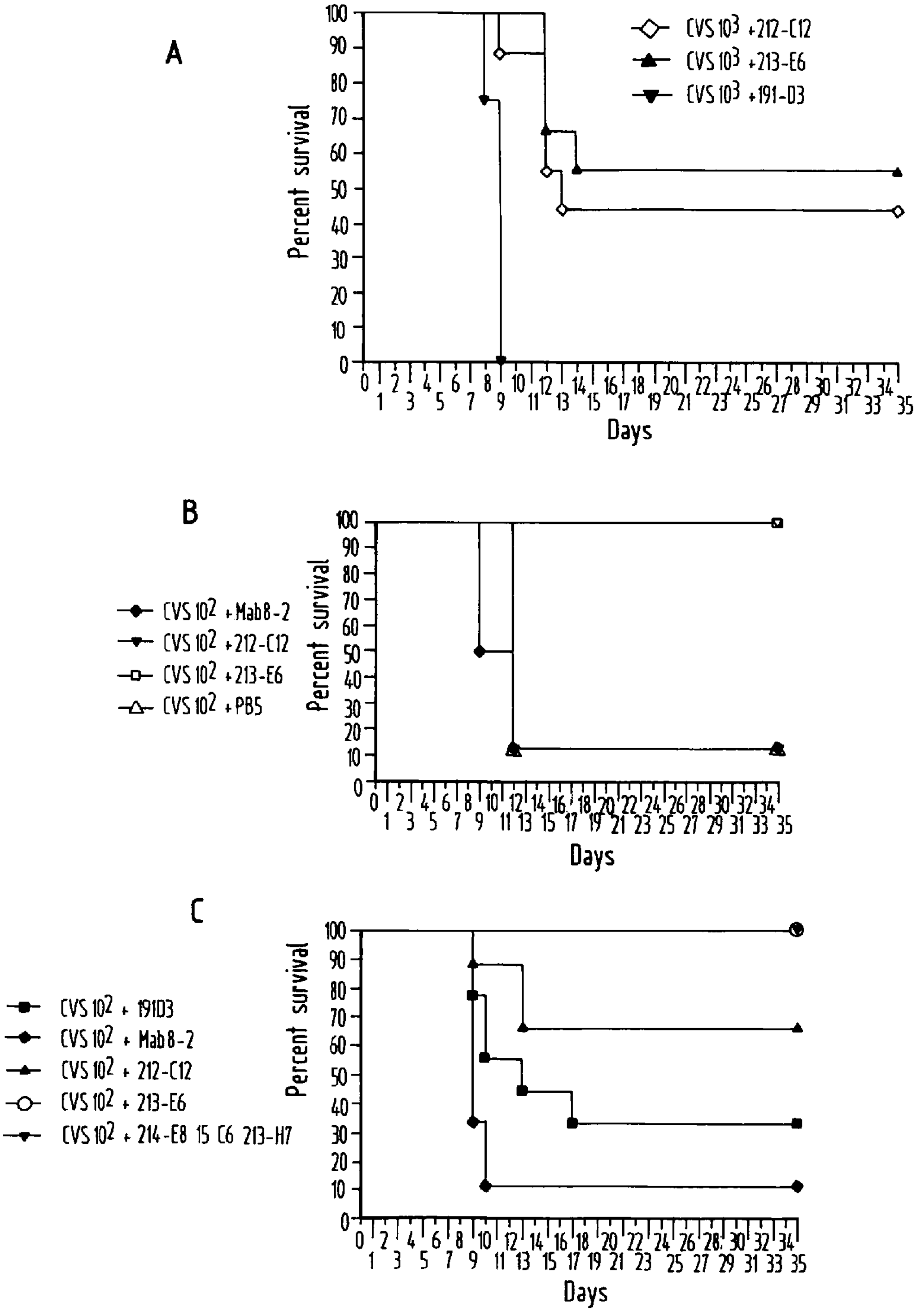
FIG. 47A-C: Kaplan Meier curve showing the survival proportion of mice inoculated intranasally with a mix of CVS-11 and 1 IU of NANOBODY® ($V_{HH}$ sequence) or antibody. A dose of $10^3$ $TCID_{50}$ was used in the experiment of graph A and a dose of $10^2$ $TCID_{50}$ in the experiments of graph B and C.

The results are shown in FIGS. 47A and B and Table C-47. At the lower virus dose, 213-E6 and 212-C12 present 100% of protection while at the higher dose they present a partial protection.

Both the monovalent 213-E6 and bivalent 214E8-15GS-213H7 provided full protection against disease in the intranasal inoculation model when introduced together with the virus at a viral dose of $10^2$ $TCID_{50}$. At a higher dose of $10^3$ $TCID_{50}$ protection was partial.

Figure 53:
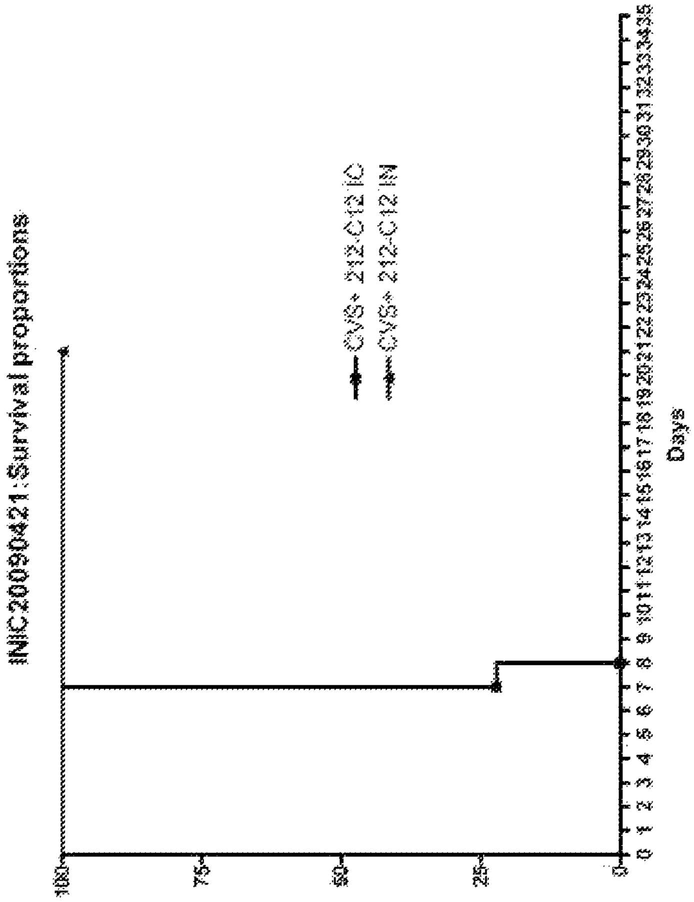
FIG. 53: Kaplan Meier curve showing the survival proportion of mice upon intranasal or intracerebral inoculation of $10^2$ $TCID_{50}$ CVS-11 mixed with 1 IU 212-C12.

Remarkably, the monovalent clone 212-C12 provided relative good protection in this model, whereas in the intracerebral inoculation model we observed no protection with this clone. To confirm this observation, we performed an additional experiment in which we inoculated part of the mice intranasally and part intracerebrally with CVS-11+212-C12 (FIG. 53 and Table C-50). Again, intranasally inoculated mice were fully protected, whereas intracerebral inoculation yielded 100% mortality.

The mortality and survival curve of the group inoculated with the mix of virus and irrelevant NANOBODY® ($V_{HH}$ sequence) 191-D3 is comparable to that of mice inoculated with virus only in previous experiments.

Surprisingly, we observed no protection with the mab 8-2, despite the fact that this mab proved to be a very potent neutralizer in the in vitro models and in the intracerebral inoculation model. In this experiment, the mortality was even higher (89%) and the median survival time was shorter (9 days) than in group with the irrelevant NANOBODY® ($V_{HH}$ sequence) (respectively 66% and 13 days). This experiment will be repeated with another mab (RV1C5).

Example 52

In Vivo Protection of Mice by Intranasal Application of NANOBODY® ($V_{HH}$ Sequence) Followed One Day Later by Intranasal Challenge with the Virulent Neurotropic CVS-11 Strain Intranasal challenge with a virulent neurotropic rabies virus quickly leads to invasion of the brain, most probably upon entry and infection of the sensory neurons of the olfactory epithelium.

Figure 45:
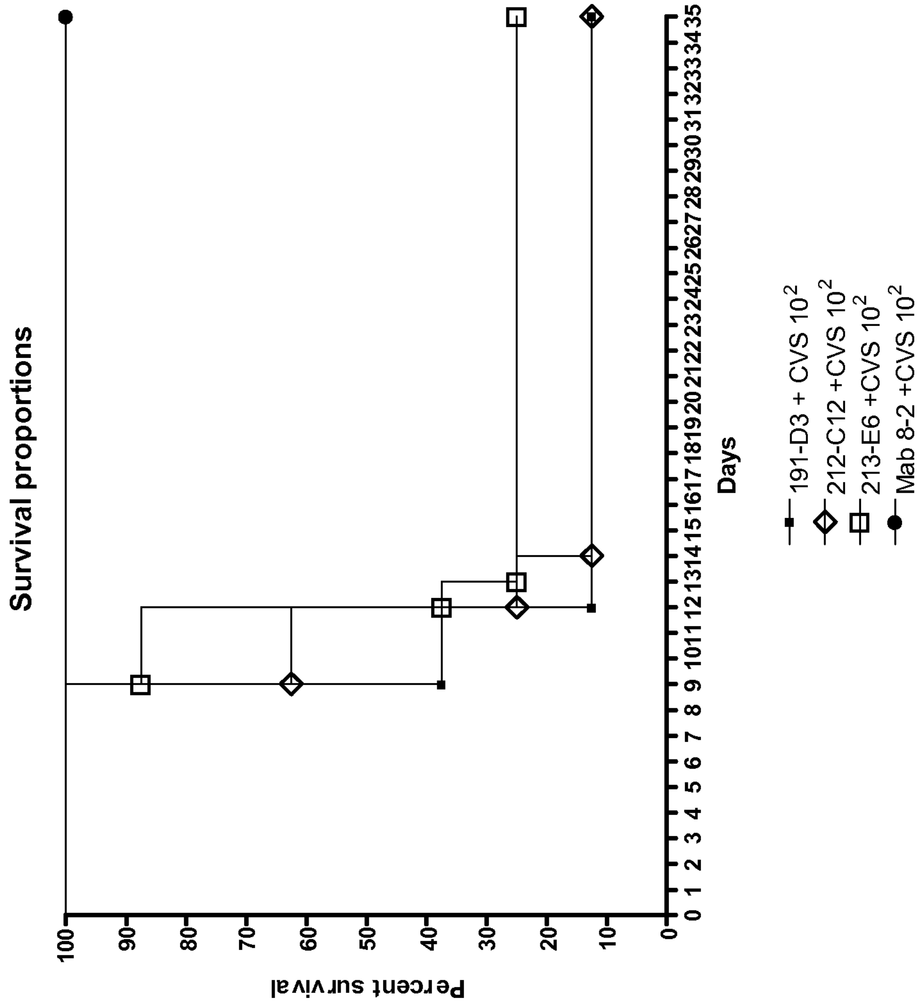
FIG. 45: Kaplan Meier curve showing the survival proportion of mice after intranasal administration with NANOBODIES® ($V_{HH}$ sequences) followed by intranasal inoculation of the virulent CVS-11 strain one day later.

To examine whether prior intranasal administration of anti-rabies NANOBODIES® ($V_{HH}$ sequences) can protect mice from an intranasal challenge with rabies virus one day later, outbred Swiss mice (5-6 weeks old) were treated with an intranasal dose of NANOBODY® ($V_{HH}$ sequence) (1 IU) or mab (1 IU). One day later, the mice received an intranasal challenge of $10^2$ $TCID_{50}$CVS-11 per mouse. For intranasal inoculation, a volume of 25 μl/mouse was applied in both nostrils under isoflurane anesthesia. Mice were examined for (rabies) disease signs each work day and a clinical score was given per day per mouse. Clinical scores ranged from 0 (no disease signs) to 7 (conjunctivitis, weight loss, depression, hunched back, wasp waist, incoordination and hind limb paralysis). At score 6, mice were sacrificed by cervical dislocation. The experiment ended at 35 DPI with virus. The results are shown in FIG. 45 and Table C-46. The peak clinical score and the mean time of death of the anti-rabies NANOBODY® ($V_{HH}$ sequence) groups (212-C12, 213-E6) was not significantly different from the 191-G2 control group, in contrast to the monoclonal antibody group (P<0.01, one-way ANOVA with Dunnett's post-Test).

Similar to the intracerebral inoculation model, we observed full protection with mab 8-2 (0% mortality), no protection with NANOBODY® ($V_{HH}$ sequence) 212-C12 (87.5% mortality) and minor protection with NANOBODY® ($V_{HH}$ sequence) 213-E6 (75% mortality).

Example 53

Generation of NANOBODY® ($V_{HH}$ Sequence) Constructs

For the expression of the NANOBODY® ($V_{HH}$ sequence) constructs the GS Gene Expression System™ by Lonza (Basel, Switzerland) is used, which comprises the serum-free and suspension-adapted CHOK1SV cell line and the expression plasmid pEE12.4. The starting point of the construction of the NANOBODY® ($V_{HH}$ sequence) constructs is the reverse translation of the amino acid sequence into the corresponding nucleotide sequence, optimized for expression in a CHO cell line. This optimization for expression can for instance be done by GeneArt (Regensburg, Germany) or by other companies specialized in gene synthesis. On the N-terminal end of the NANOBODY® ($V_{HH}$ sequence) construct a generic secretion signal is added, which allows for the endogenous protein to be exported into the growth medium and which is cleaved off upon secretion out of the cell. Such a generic signal sequence can, for instance, be the murine heavy chain leader sequence, the murine light chain leader sequence, any other antibody heavy or light chain leader sequence, the IL-2 secretion signal, etc., as are known in the art. Optionally, 5' to the end of the secretion signal an optimized Kozak sequence is added, which initiates effective translation from the mRNA transcript. The consensus sequence recommended by Lonza consists of a 9-mer (5'-GCCGCCACC-3'; SEQ ID NO: 2638), and directly precedes the ATG start codon. The NANOBODY® ($V_{HH}$ sequence) construct is terminated by a double stop codon to increase translation efficiency of the construct.

The NANOBODY® ($V_{HH}$ sequence) construct including all aforementioned features is typically cloned into the HindIII/EcoRI cloning sites; which requires absence of these sites within the NANOBODY® ($V_{HH}$ sequence) construct. Cloning into the HindIII/EcoRI sites on the pEE12.4 plasmid results in the removal of most of the multiple cloning site. The recombinant plasmid is transformed into an appropriate *E. coli* strain (e.g., TOP10), and positive clones are selected for by ampicillin or carbenicillin in the growth medium. The plasmid is amplified and isolated using a plasmid isolation kit.

To transfect the cells, the recombinant plasmid DNA is linearized for instance by digestion with a restriction endonuclease (e.g., PvuI) that cuts the DNA only once; this facilitates the recombination of the plasmid DNA into the cells genome. Freshly thawed CHOK1 SV cells are kept in culture (e.g., in CD CHO medium, Invitrogen) and are expanded. An aliquot of about $2\times10^7$ cells is electroporated with 40 g of linearized plasmid, using e.g., the BioRad electroporation device (Bio-Rad Gene Pulser. Hercules, Calif.). The transfected cells are resuspended in CD CHO medium and after 1 day put under selective pressure, e.g., in glutamine-deficient medium. To increase selective pressure the medium is supplemented with 66.6 μM methionine sulfoximine after 1 culturing day. The cells are kept under selective pressure, and allowed to expand, either as single cell clones (after limiting dilution), or as a batch culture. Expression levels of the recombinant protein are then determined by e.g. a binding ELISA.

The IgG1-hinge region between the NANOBODY® ($V_{HH}$ sequence) and the immunoglobulin IgG1 constant domain CH2-CH3 can optionally be extended by a 9GS linker (GGGGSGGGS; SEQ ID NO: 2639) or exchanged by another hinge region, e.g., as derived from IgG3 (ELKTPLGDTTHTCPRCPEPKSCDTPPPCPRCPEPKSCDTPPPCPRCPEPKSCDTPPPCP RCP; SEQ ID NO: 2640). In a format where one NANOBODY® ($V_{HH}$ sequence) is preceding and another NANOBODY® ($V_{HH}$ sequence) following the IgG-Fc domain, the second C-terminal NANOBODY® ($V_{HH}$ sequence) can be fused to the Fc domain either directly (no linker), or e.g., by a 9GS linker.

Non-limiting embodiments of the NANOBODY® ($V_{HH}$ sequence) Fc fusion construct include:

(1) NC41::15GS::NC41::G1-hinge::IgG1-Fc
(2) NC41::15GS::NC41::9GS-G1-hinge::IgG1-Fc
(3) NC41::15GS::NC41::G3-hinge::IgG1-Fc
(4) NC41::G1-hinge::IgG1-Fc::NC41
(5) NC41::9GS-G1-hinge::IgG1-Fc::NC41
(6) NC41::G3-hinge::IgG1-Fc::NC41
(7) NC41::G1-hinge::IgG1-Fc::9GS::NC41
(8) NC41::9GS-G1-hinge::IgG1-Fc::9GS::NC41
(9) NC41::G3-hinge::IgG1-Fc::9GS::NC41
(10) NC41::G1-hinge::IgG1-Fc::15B3
(11) NC41::9GS-G1-hinge::IgG1-Fc::15B3
(12) NC41::G3-hinge::IgG1-Fc::15B3
(13) NC41::G1-hinge::IgG1-Fc::9GS::15B3
(14) NC41::9GS-G1-hinge::IgG1-Fc::9GS::15B3
(15) NC41::G3-hinge::IgG1-Fc::9GS::15B3
(16) NC41::NC41::IgG1-Fc
(17) NC41::IgG1-Fc::NC41
(18) 191D3::15GS::191E4::G1-hinge::IgG1-Fc
(19) 191D3::15GS::191E4::9GS-G1-hinge::IgG1-Fc
(20) 191D3::15GS::191E4::G3-hinge::IgG1-Fc
(21) 191D3::G1-hinge::IgG1-Fc::NC41
(22) 191D3::9GS-G1-hinge::IgG1-Fc::191E4
(23) 191D3::G3-hinge::IgG1-Fc::191E4
(24) 191D3::G1-hinge::IgG1-Fc::9GS::191E4
(25) 191D3::9GS-G1-hinge::IgG1-Fc::9GS::191E4
(26) 191D3::G3-hinge::IgG1-Fc::9GS::191E4
(27) 191D3::191E4::IgG1-Fc
(28) 191D3::IgG1-Fc::191E4

Figure 46:
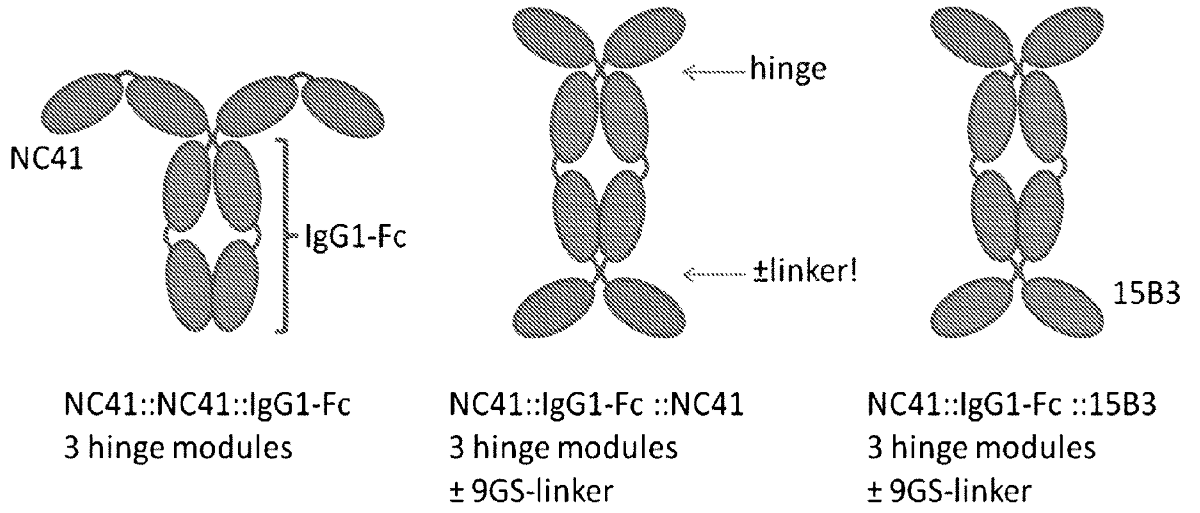
FIG. 46: Non-limiting examples of NANOBODY® ($V_{HH}$ sequence) constructs.

Non-limiting examples of NANOBODY® ($V_{HH}$ sequence) constructs of the invention are also provided in FIG. 46. The sequences of the above constructs (1)-(28) are provided in Table A-5 below. A nucleic acid sequence corresponding to (16) and (17) with random codon usage is also shown in Table A-5 below.

Example 54

Cross-Reactivity of NANOBODY® ($V_{HH}$ Sequence) 202-C8

Cross-Reactivity of Mono-, Bi- and/or Trivalent NANOBODY® $V_{HH}$ Sequence) 202-C8

Potential heterosubtypic cross-reactivity of monovalent 202-C8 (SEQ ID NO: 138), bivalent 202-C8 (SEQ ID NO's: 2423 to 2424) and trivalent 202-C8 (SEQ ID NO's: 2425 to 2426) is assessed in an in vitro neutralization assay using PR8 (H1N1), X47 (H3N2) and NIBRG-14 (H5N1) viruses. Neutralization is tested in a hemagglutination inhibition assay using chicken red blood cells and in a virus microneutralization assay using MDCK cells as targets.

In Vivo Neutralization of Mono-, Bi- and/or Trivalent NANOBODY® ($V_{HH}$ Sequence) 202-C8

An in vivo experiment with the 202-C8 variants (mono-, bi- and/or trivalent) that display good cross-reactive potential is performed. Mice are treated with the mono-, bi- and/or trivalent 202-C8 NANOBODIES® ($V_{HH}$ sequences) and subsequently challenged with 1 $LD_{50}$ of mouse-adapted PR8, X47 or NIBRG-14 virus.

Groups of 3 mice are used. At t=0 mice receive 100 microgram of 202-C8 (mono-, bi- or trivalent), 100 microgram of 191-D3 (control NANOBODY® ($V_{HH}$ sequence)) or 50 µl of PBS intranasally. Four hours later mice are challenged with 1 $LD_{50}$ of mouse adapted NIBRG-14, PR8 or X47 virus. As an indicator of morbidity, body weight of mice is determined on a daily basis. On day 4 after challenge all mice are sacrificed and lung homogenates prepared in 1 ml PBS. The amount of infectious virus in the lung homogenates is determined by titration on MDCK cells and by a genome specific qRT-PCR. The experiment is repeated at least one time.

Example 55

Evaluation of Proteolytic Resistance of Bivalent RSV NANOBODY® ($V_{HH}$ Sequence) in Mouse Lungs The proteolytic resistance of the bivalent RSV101 (191D3-15GS-191D3; SEQ ID NO: 2382) in mouse lungs was evaluated by analysis of mouse lung homogenates and compared with control NANOBODY® ($V_{HH}$ sequence) 12B2biv.

NANOBODY® ($V_{HH}$ sequence) was administered to mice 5 hours prior to infections with RSV. Lungs were removed and homogenized 3 or 5 days after infection with RSV. In short, lungs from 5 mice were homogenized and 40 µl SDS-sample buffer (6× Laemli/20% β-mercapto) was added to 200 µl homogenate. As a positive control, 100 ng of RSV101 (0.1 mg/ml) in PBS was used to obtain a 10 µg/ml solution (5 µl NB2biv+45 µl PBS+25 µl SB (Invitrogen NP0008; Lot 401488)+DTT (10 mg/ml)).

24 µl (=20 µl lung homogenate) of samples and 15 µl of positive control were loaded on a 12% gel (NuPAGE Bis-Tris Invitrogen NP0341BOX; Lot 8031371) and run for 45 min at 200V. As marker Precision Plus Dual Color Protein Standard (Biorad; 161-0374) was used. After the run, the gel was transferred to a nitrocellulose membrane (Invitrogen i-blot dry blotting system; program2: 6 min at 23V) and blocked with Odyssey blocking buffer (Li-cor 927-40000; Lot 2782) for 1 h at RT. All incubation and wash steps were done on a rolling plate (100 rpm). The membrane was incubated with polyclonal rabbit antiserum K1 (as primary antibody diluted 1/1000 in Odyssey blocking buffer) for 1 h at RT. Washing was carried out 3×5 min with PBS/0.1% Tween20. Detection was done with goat anti-rabbit IgG (H+L)-DyLight800 (Pierce 35571; Lot IH112638; diluted 1/10000 in Odyssey blocking buffer) for 1 h at RT. Subsequent washing was carried out 3×5 min with PBS/0.1% Tween20. The membrane was scanned with the Odyssey Infrared Imager system (in the 800 channel) (Sensitivity on Odyssey: Linear manual 4; Licor Biosciences).

Figure 49:
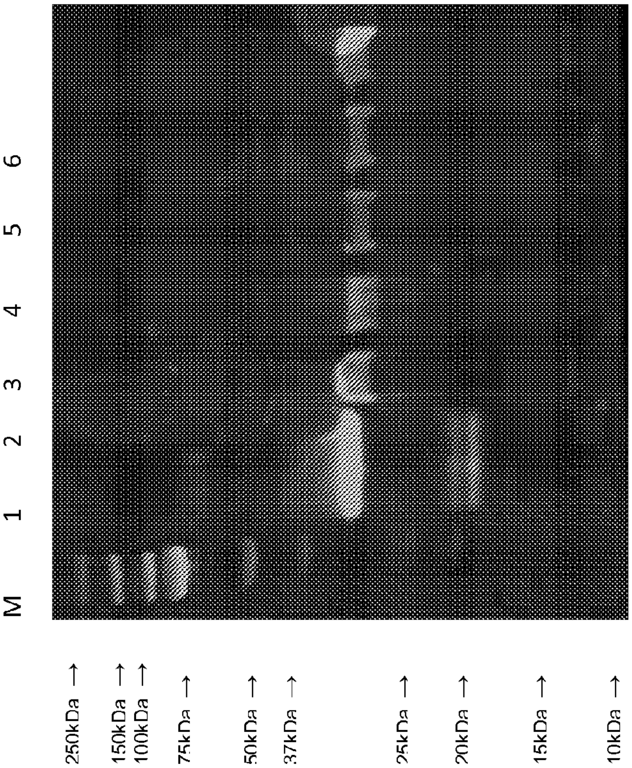
FIG. 49: Western blot of lung homogenates of mice after intranasal administration of bivalent NANOBODY® ($V_{HH}$ sequence) RSV101 as described in Example 55. M: Marker; 1: pos control (100 ng NB2biv); 2-6: mice inoculated with NB2biv NANOBODY® ($V_{HH}$ sequence).

Results of the Western blot are shown in FIG. 49. The positive control was well detected by the K1 antiserum. RSV101 was also detected in the lung homogenates, however with lower intensity.

Determination of the concentration was done with the Odyssey v3.0 software (FIG. 55 and Table C-51).

Example 56

Neutralization of Escape Mutants of the Long Strain by Formatted NANOBODIES® ($V_{HH}$ Sequences)

In examples 27 and 28, the binding of monovalent NANOBODIES® ($V_{HH}$ sequences) to typical antigenic site II and/or IV-VI RSV escape mutants has been described. Binding of NANOBODIES® ($V_{HH}$ sequences) specifically recognizing these antigenic sites was almost lost or significantly reduced. Formatting of these NANOBODIES® ($V_{HH}$ sequences) into bi- or trivalent constructs partially restored binding activity but not for all three escape mutant viruses. Binding to the escape mutant R7C2/1 (mutation K272E in antigenic site II) remained below the level of 25% for any bi- or trivalent construct consisting solely of antigenic site II binding NANOBODIES® ($V_{HH}$ sequences). The NANOBODIES® ($V_{HH}$ sequences) 15B3 and 191E4, which are binding to antigenic site IV-VI, were the only NANOBODIES® ($V_{HH}$ sequences) (as such or in biparatopic constructs) able to bind this mutant at a level of 75% or more.

More detailed analysis of the data indicated that binding towards R7C2/1 slightly increased when the valency of the NANOBODY® ($V_{HH}$ sequence) was increased. The binding of 7B2 constructs was 0, 4.4 and 13% respectively for the monovalent, bivalent (RSV 106) and trivalent (RSV400) formats. Such a low level of residual binding is expected to result in very high loss of potency to neutralize RSV.

The neutralizing potency of NANOBODIES® ($V_{HH}$ sequences) was assessed on the same selected set of escape mutants as described in example 28. For this purpose the monovalent NANOBODIES® ($V_{HH}$ sequences) 7B2, 15H8 and NC41 were compared to their respective trivalent counterparts, RSV400, RSV 404 and RSV 407. Of note, in example 28 only RSV400 was assessed for binding these escape mutants. In addition also the biparatopic trivalent molecule RSV403 (7B2-15B3-7B2) was analyzed for its neutralizing capacity.

The hRSV micro neutralization assay was essentially performed as described in example 15. In brief, Hep2 cells were seeded at a concentration of $1.5\times10^4$ cells/well into 96-well plates in DMEM medium containing 10% fetal calf serum (FCS) supplemented with Penicillin and Streptomycin (100 U/ml and 100 µg/ml, respectively) and incubated for 24 hours at 37° C. in a 5% $CO_2$ atmosphere. Viral stocks of different viruses were prepared into Hep2 cells and subsequently titrated to determine the optimal infectious dose for use in the micro neutralization assay. A standard quantity of the specific hRSV strain was pre-incubated with serial dilutions of purified NANOBODIES® ($V_{HH}$ sequences) in a total volume of 50 µl for 30 minutes at 37° C. The medium of the Hep2 cells was replaced with the premix to allow infection for 2 hours, after which 0.1 ml of assay medium was added. The assay was performed in DMEM medium supplemented with 2.5% fetal calf serum and Penicillin and Streptomycin (100 U/m1 and 100 µg/ml, respectively). Cells were incubated for an additional 72 hours at 37° C. in a 5% CO2 atmosphere, after which cells were washed twice with 0.05% Tween-20 in PBS and once with PBS alone, after which the cells were fixed with 80% cold acetone (Sigma-Aldrich, St. Louis, Mo.) in PBS (100 µl/well) for 20 minutes at 4° C. and left to dry completely. Next the presence of the F-protein on the cell surface was detected in an ELISA type assay. Thereto, fixed Hep2 cells were blocked with 5% Porcine Serum Albumin solution in PBS for 1 hour at room temperature, than incubated for 1 hour with anti-F-protein polyclonal rabbit serum (Corral et al. 2007, BMC Biotechnol. 7: 17) or Synagis® (2 µg/ml). For detection goat Anti-rabbit-HRP conjugated antibodies or goat Anti-Human IgG, Fcγ fragment specific-HRP (Jackson ImmunoResearch, West Grove, Pa.) was used, after which the ELISA was developed according to standard procedures.

Figure 50A:
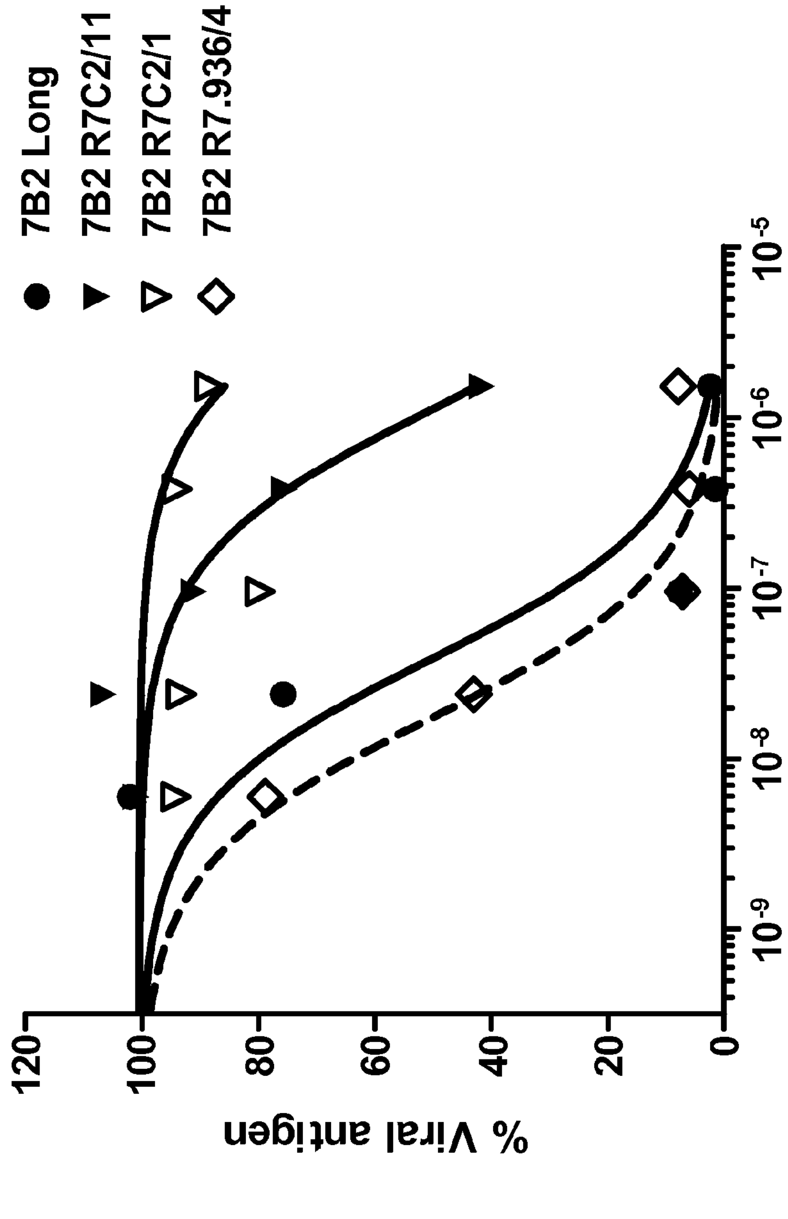
FIG. 50: Neutralization assay of RSV Long and the escape mutants R7C2/1; R7C2/11 and R7.936/4 by the monovalent NANOBODIES® ($V_{HH}$ sequences) 7B2 (A), 15H8, (B) NC41 (C) at a concentration range from about 2 μM to 6 nM and the trivalent NANOBODIES® ($V_{HH}$ sequences) RSV 400 (D), RSV404 (E), RSV 407 (F) and RSV 403 (G) at a concentration range of about 20 nM to 100 pM. Curve fitting was only done for data of monovalent NANOBODIES® ($V_{HH}$ sequences).
Figure 50:
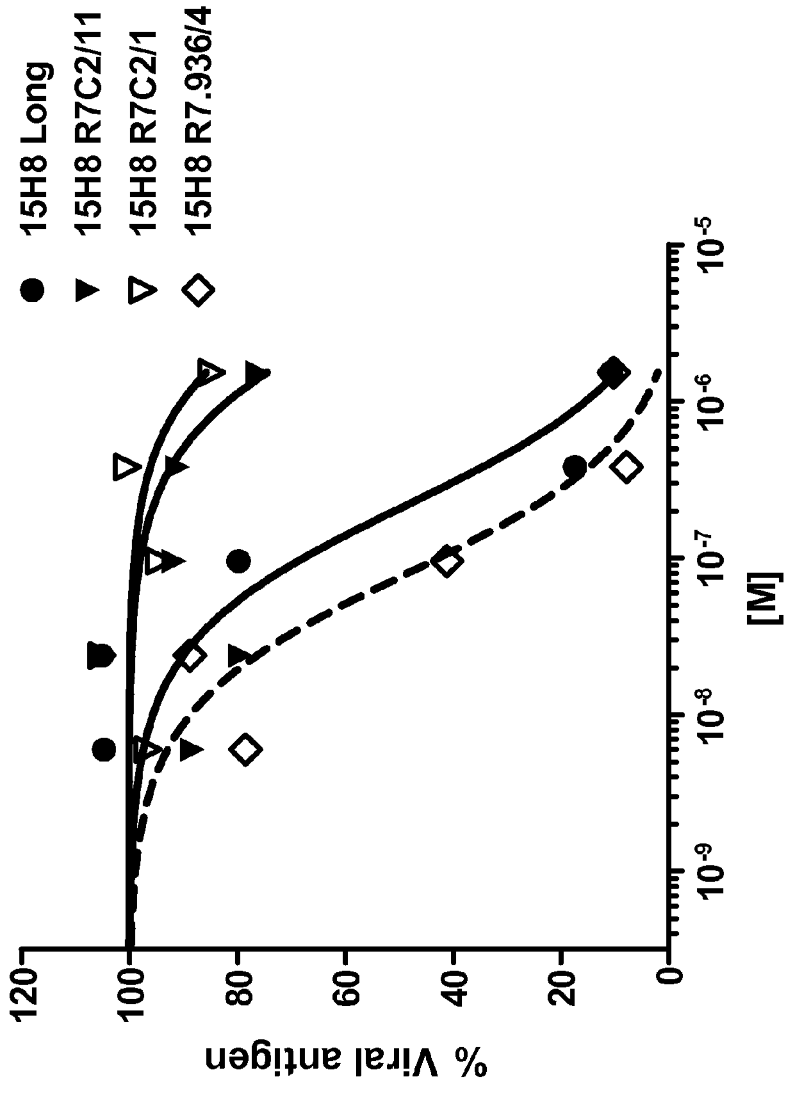
Figure 50:
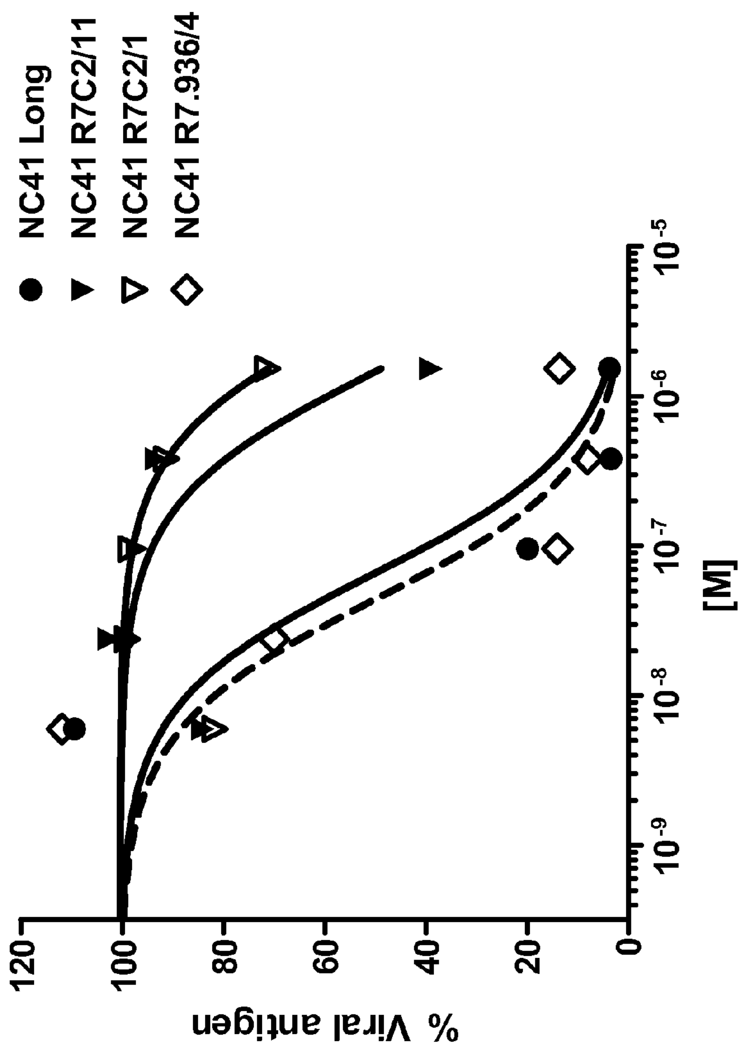
Figure 50:
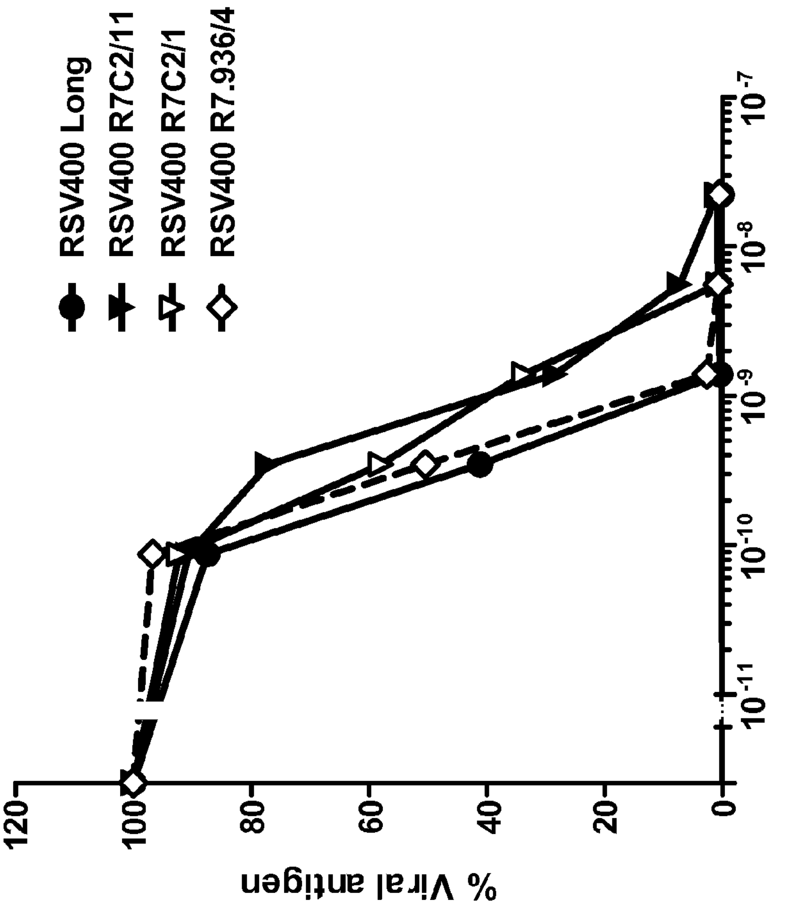
Figure 50:
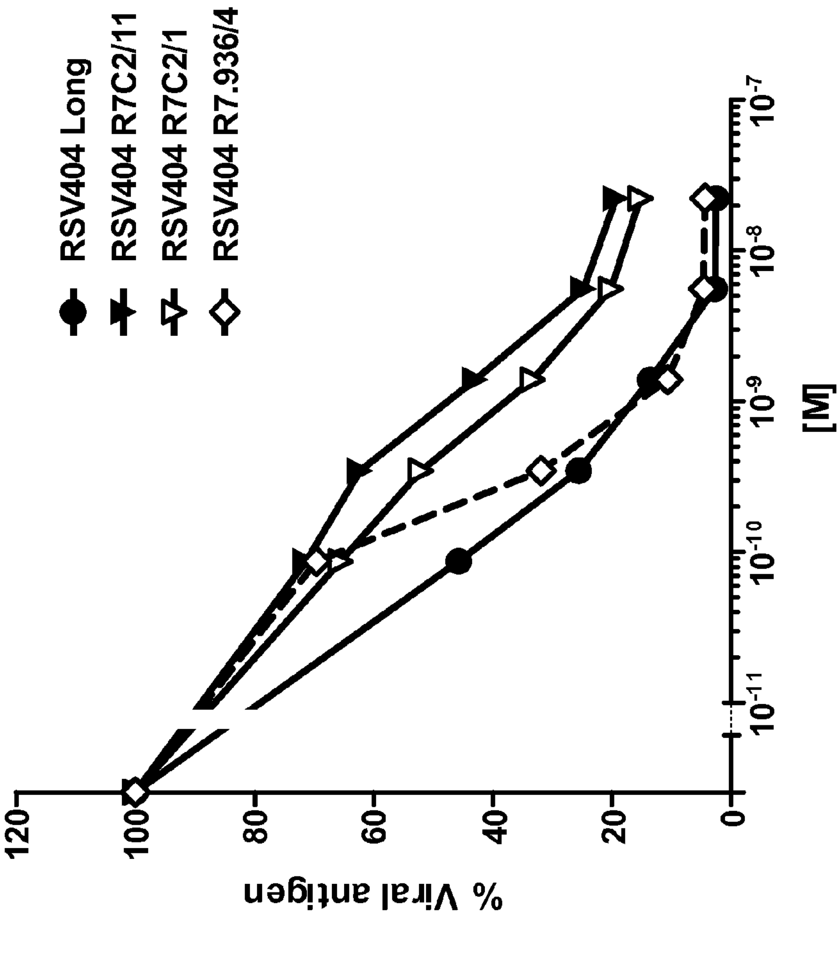
Figure 50:
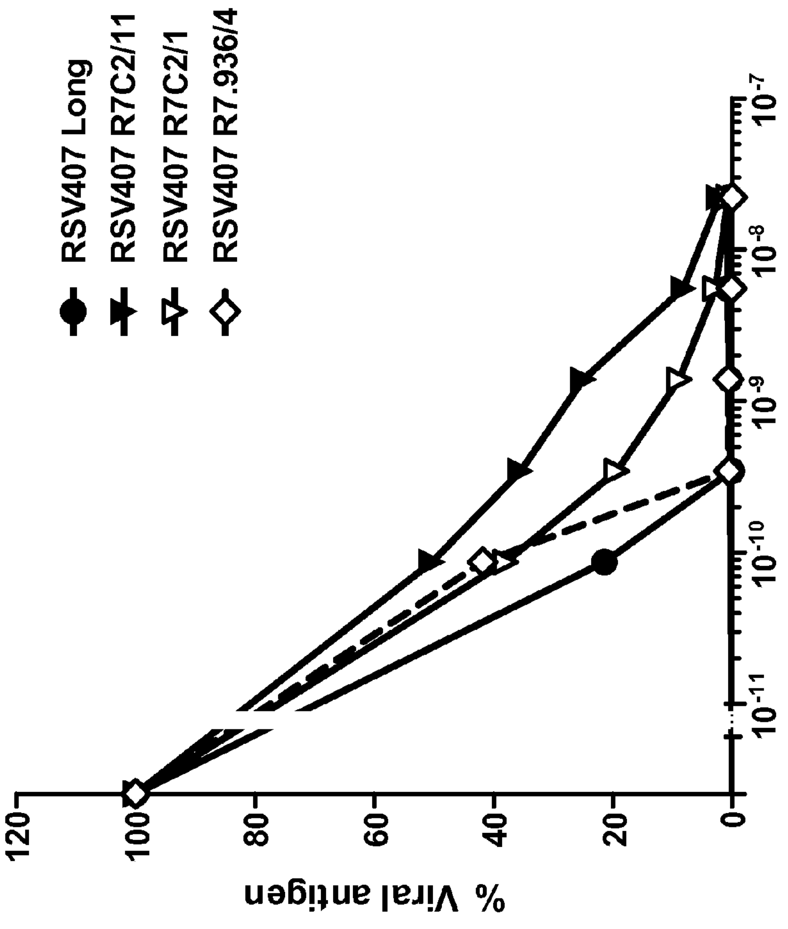
Figure 50:
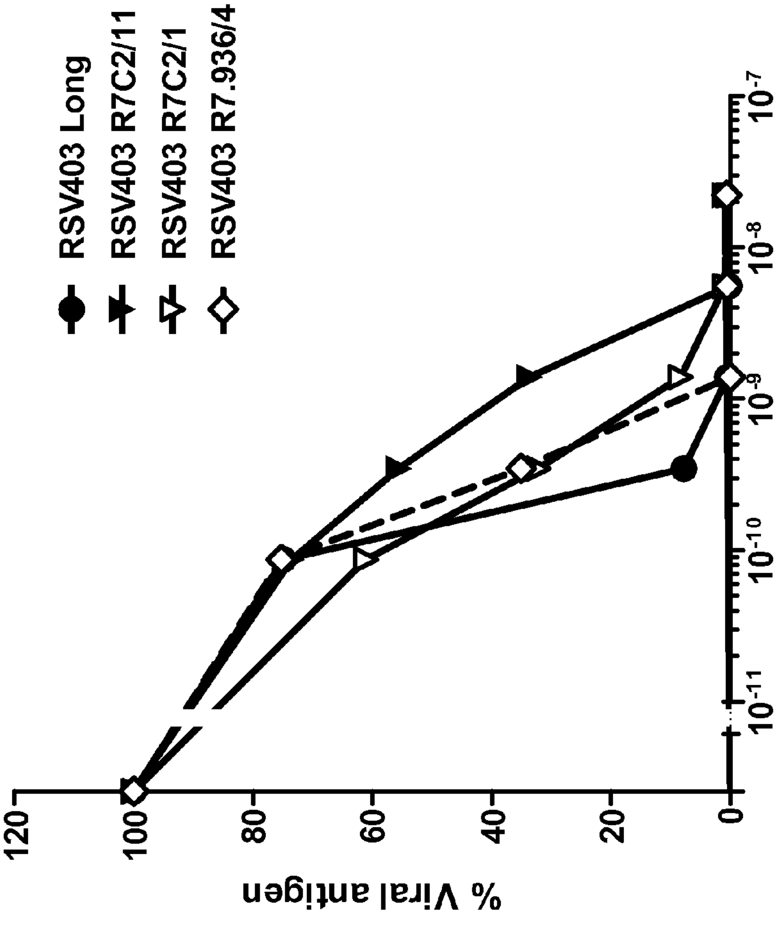

As shown in FIGS. 50 A-C, the monovalent NANOBODIES® ($V_{HH}$ sequences) had almost no neutralizing potential towards the antigenic site II escape mutant viruses R7C2/11 and R7C2/1. The potency to neutralize the R7.936/4 antigenic site IV-VI variant was comparable to the potency to neutralize the wild type Long strain. These data are in line with the binding data of example 27 and the epitope mapping as described for these NANOBODIES® ($V_{HH}$ sequences) in example 20.

The trivalent molecules however, were potently neutralizing all 3 escape mutants (FIGS. 50 D-G). Maximal inhibition was observed at concentrations as low as about 20 nM while this level of inhibition was not observed for the monovalent Nbs at concentrations up to 2 µM. The potent neutralization of R7C2/1, almost equivalent to the neutralization of R7C2/11, is most surprising since example 28 showed a very significant loss of binding activity for the trivalent molecule RSV400 which was expected to result in a very high loss of neutralization potency.

The bivalent IgG Palivizumab (Synagis®), also recognizing antigenic site II was not able to block replication of R7C2/1 or R7C2/11 significantly at concentrations of about 0.2 µM. At this concentration an IC50 was not reached while R7.936/4 and wild type Long virus were neutralized with an IC50 of a few nM (data not shown).

Example 57

Screening for NANOBODIES® ($V_{HH}$ Sequences) that Compete with C179 for Binding Hemagglutinin H5 of Influenza C179 is a mouse monoclonal antibody which neutralizes H1, H2 and H5 subtypes influenza viruses. It does not prevent attachment of viruses to sialic acid, but instead binds to a rather conserved region on the stem of HA. Monoclonal antibody C179 neutralizes virus by stabilizing the metastable HA and prevents as such the low pH-induced conformational change and fusion of viral and cellular membranes. To isolate NANOBODIES® ($V_{HH}$ sequences) with a similar binding and neutralizing characteristic, competition assays were set up between NANOBODIES® ($V_{HH}$ sequences) that bind H5 hemagglutinin and the monoclonal, neutralizing antibodies C179 (Okuno et al. 1993, J. Virol. 67: 2552-2558). In short, the H5 antigen was immobilized on Maxisorp microtiter plates (Nunc) and free binding sites were blocked using 4% Marvel in PBS. Next, 125 ng/ml of C179 was preincubated with 10 and 20 µl of periplasmic extract containing NANOBODY® ($V_{HH}$ sequence) of the different clones. The competing antibody was allowed to bind to the immobilized antigen with or without NANOBODY® ($V_{HH}$ sequence). After incubation and a wash step, antibody binding was revealed using a HRP-conjugated donkey anti-mouse antibody. Binding specificity was determined based on OD values compared to controls having received no NANOBODY® ($V_{HH}$ sequence).

Figure 56:
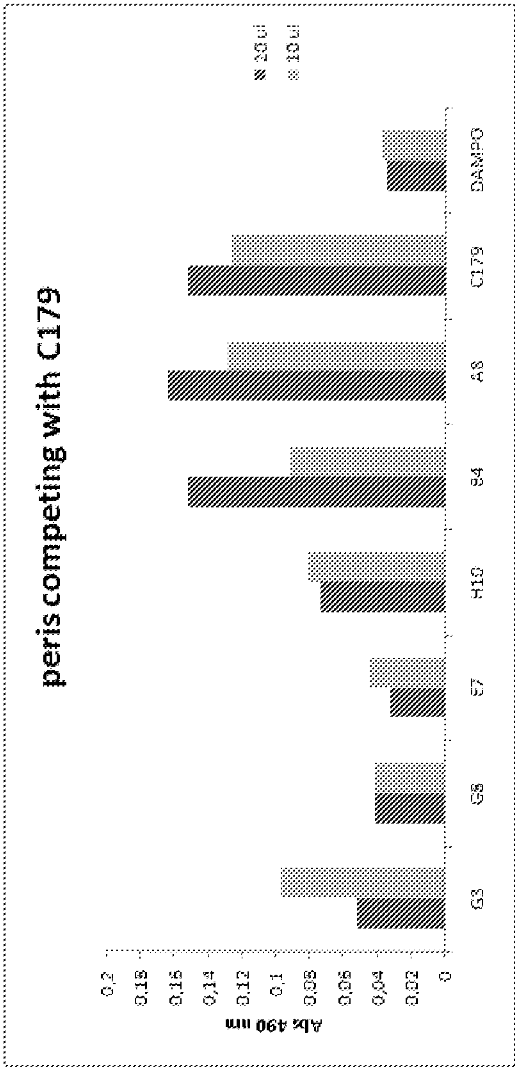
FIG. 56: Screening for NANOBODIES® ($V_{HH}$ sequences) that compete with the monoclonal antibody C179 for binding hemaglutinin H5 of influenza virus as described in Example 57.

This way, 4 NANOBODIES® ($V_{HH}$ sequences) were identified which competes with C179 (LG203G8; SEQ ID NO:

2683, LG203E7; SEQ ID NO: 2682, LG203H10; SEQ ID NO: 2446 and LG203G3; SEQ ID NO: 2442) (FIG. 56).

Example 58

Optimization of Linker Length of NC41 Trivalents

To determine the impact of the linker length of trivalents of NC41, different constructs with linkers ranging from 3Ala, 9GS, 15GS, to 20GS linkers (RSV408, RSV409, RSV407 and RSV410 resp.) were generated. All four NC41 trivalents were able to completely neutralize both RSV B-1 and Long strains (FIG. 5). No effect of linker length was observed in neutralization of RSV Long, as all constructs were equally potent. By contrast, the constructs with 9GS and 3Ala linkers had increased IC50 values on the B-1 strain, indicating that a minimal linker length of 15GS is required for maximal potency. This may be explained by the observation that bivalent NC41 constructs already are very potent neutralizers on Long, while on the B-1 strain the potency difference between bivalent and trivalent NC41 is much larger (see example 25). In RSV408 and RSV409 the accessibility of the middle NANOBODY® ($V_{HH}$ sequence) may be less optimal.

Example 59

Humanization of NANOBODY® ($V_{HH}$ Sequence) NC41

The sequence of NANOBODY® ($V_{HH}$ sequence) NC41 was aligned to the human germline VH3-23. to allow selection of residues suitable for further humanization of the NANOBODY® ($V_{HH}$ sequence) sequence. In addition, in silico analysis was done to identify residues that are potentially prone to post-translational modifications, such as Asp isomerisation, and to identify mutations that might improve the chemical stability. The CDR regions and the so-called Hallmark residues, which are known to be essential for the stability and potency of NANOBODIES® ($V_{HH}$ sequences) were excluded for modification.

For NC41 in total 11 positions were selected for mutation to the corresponding human residue: Four mutations were simultaneous introduced (Val5Leu, Ala14Pro, Glu44Gly, Gln108Leu), as these residues were not expected to dramatically affect the NANOBODY® ($V_{HH}$ sequence) function (based on data from other NANOBODIES® ($V_{HH}$ sequences)). In this basic variant, seven residues of which it was unknown whether mutation to the human counterpart was allowed (Ser19Arg, Ile2Oleu, Ala74Ser, Gly78Leu, Ala83Arg, Asp85Glu, Arg105Gln) were mutated using a library approach, allowing either the wildtype or the corresponding human amino acid at each position. The resulting library, with a theoretical diversity of 128, was generated by gene assembly using overlapping oligonucleotide sequences containing degenerated codon use, and subsequently cloned into an expression vector derived from pUC119 which contained the LacZ promoter, a resistance gene for kanamycin, a multicloning site and the OmpA leader sequence. In frame with the NANOBODY® ($V_{HH}$ sequence) coding sequence, the vector coded for a C-terminal c-myc tag and a (His)6 tag. NANOBODIES® ($V_{HH}$ sequences) were produced in the periplasm of *E. Coli* (see Example 22). Library diversity was confirmed by sequence analysis.

Periplasmic extracts from 368 individual NC41 variants and wildtype NC41 were generated and subjected to a functional screening cascade to identify the best humanized NC41 variant, in terms of both potency and stability.

In a first step, RSV binding of humanized NC41 variants to RSV Long was determined in ELISA (Hytest, Turku Finland; #8RSV79) (see Example 22).

Moreover, the positive binders were analyzed for binding to Hep2 cells infected with RSV B-1 strain. In here, Hep2 cells were seeded into 96-wells plates and infected with RSV B-1 strain, essentially following the procedure described for the neutralization assay (see Examples 15 and 21). Three days later cells were fixed with ice-cold acetone and plates were used in an ELISA assay using periplasmic extracts at different dilutions. NANOBODY® ($V_{HH}$ sequence) binding to Hep2-B1 infected cells was detected using anti-VHH rabbit polyclonal antibody, followed by goat Anti-rabbit-HRP conjugated antibodies, after which the ELISA was developed according to standard procedures.

Additionally, in order to verify if the introduced mutations affected the temperature stability, periplasmatic extracts of all binders were heated to 74° C. for 2 hours, which is 5° C. above the melting temperature of wildtype NC41. The binding to RSV long before and after heating was analyzed in ELISA, and the ratio of binding signal after vs before heating was taken as measure for temperature stability.

Finally, the kinetic off-rates of the variants were determined in Biacore assay on the $F_{tm}$-NN protein, as described in Examples 12 and 22.

All binders were sequenced and ranked according to their capacity to bind the F-protein of RSV. When analyzing the sequences of the strongest binders, a clear preference for Gln105 (human residue) was observed in all cases. Whereas the Ile20Leu mutation appeared underrepresented, for all other positions there was no clear preference for either the wild type or the human sequence, with variants containing up to 10 mutations compared to wildtype NC41. Notably, in one variant an additional pointmutation (Gly54Asp) within the CDR2 region was observed. This variant, NC41 variant 6, showed the lowest off-rate of all variants and wildtype NC41, resulting in affinity increase.

Based on the sequence and functional data, 18 variants (Table A-8) were selected for further characterization as purified proteins (FIG. 65). All variants were produced and purified, and potencies for neutralization of RSV Long and B-1 were determined in the micro neutralizations assay. While most variants showed very similar activity to wildtype NC41, several variants showed increased potency on both Long (2-fold) and B-1 (6-fold), with the strongest neutralizers being NC41 variants 6, 8, 9 17, and 18. Notably, variant 18 was maximally humanized at all 11 positions, with the additional introduction of Asp54 in the CDR2 region. Variant 10 and 11 were more potent in neutralizing B-1 strain than NC41, but not on Long strain.

For a select panel of NC41 variants the kinetic binding parameters were determined in Biacore on $F_{tm}$-NN protein (Table C-52) as described in Example 12 and 22. No significant differences in the calculated data were observed for NC41 and the humanized NC41 variants 6, 8 and 17. It should be noted that the on-rates of all NC41 variants were at the detection limit of the instrument, but the off-rates could be ranked as v06<v17<NC41<v08. The impact of the Gly to Asp mutation in CDR2 (position 54) could be clearly demonstrated when comparing v17 and v18 as this is the only difference in these maximally humanized variants. Neutralization was tested for both the Long strain and the B-1 strain in two independent assays in comparison to the NC41 wild type as shown in table B-5. In both assays NC41v18 was more potent than NC41 on both viruses and in both assays NC41v18 was more potent than NC41v17 on the Long strain.

The improved neutralization of NC41v18 was also observed for the B-1 strain in the second assay.

All NC41 variants were subjected to heat-induced unfolding to assess the effect of the introduced mutations on the stability of the protein. Thereto the melting temperature (Tm) was determined by stepwise increase in temperature in presence of Sypro Orange, a dye that binds to Trp residues that become exposed upon unfolding of the protein. All variants showed to have increased Tm relative to wildtype NC41 (69° C.), up to 9° C. for variant 18.

Three NC41 variants were formatted as trivalent constructs using 15GS linkers, NC41 variant 3 (RSV414), variant 6 (RSV426), and variant 18 (RSV427). Sequences are shown in Table A-9. All trivalents were produced and purified as described in Example 22. FIG. 67 shows the neutralization on both RSV Long and B-1 strains of two of the trivalent humanized NC41 variants with their corresponding monovalent NANOBODIES® ($V_{HH}$ sequences). Trivalents of variant 3 and 6 were 81-91 times more potent neutralizers of Long than Synagis®, and similar to wildtype NC41 trivalent. On the B-1 strain RSV414 and RSV426 were ~16 fold more potent neutralizers than Synagis, but here both were also slightly enhanced compared to the trivalent of wild type NC41 RSV407. The increased potency of monovalent variants 3 and 6 for B-1 thus appears to result in slightly improved trivalents.

Example 60

Immunisation Llamas with Foot-and-Mouth Disease Virus and Avian Influenza Virus Two llamas were immunized with mixtures of Foot-and-mouth disease virus (FMDV) and avian influenza virus (AIV) strains (Table C-53) within the high containment unit of the Central Veterinary Institute of Wageningen University and Research Centre in Lelystad, the Netherlands. The AIV strains were all low pathogenic avian influenza strains that were propagated on embryonated eggs and were not inactivated. The FMDV strains were propagated on BHK-21 cells, inactivated by treatment with 10 mM binary ethyleneimine, and concentrated by two consecutive PEG6000 precipitations. Both AIV (for protocol see Arora et. al. 1985, Analytical Biochemistry 144: 189-192) and FMDV antigens were finally purified using sucrose density gradients.

A total of three immunizations were given. The second immunization was given 28 days after the first immunization. The third immunization was given 21 days after the second immunization. All immunizations were given intramuscularly using Specol (Stimune) as an adjuvant (Bokhout et al. 1981, Vet. Immunol. Immunopath. 2: 491-500). Six days after the second and third immunization (34 and 55 days post primary immunization [DPI], respectively) 150 ml heparinized blood samples were taken for isolation of peripheral blood lymphocytes (PBLs) using Ficoll Paque Plus (GE Healthcare). Furthermore, serum was collected from both llamas at 0, 34 and 55 DPI.

The antibody response against H5 and H7 type haemagglutinin was determined using a haemagglutination inhibition test (HI) that was performed according to EU council directive 2005/94/EU. In this assay 25 μl HA antigen containing 8 haemagglutinating units was preincubated with 25 μl of a two-fold dilution series of sera for 1 hour at room temperature in a V-bottom shaped 96-well microtiter plate. After addition of 25 μl 1% chicken erythrocyte suspension and incubation at 4° C. for 45 min the HI titer was determined visually. Llama 3049, that was immunized with both H5 and H7 strains, developed HI titers against both H5 and H7 type antigen during the immunization procedure (Table C-54). Llama 3050, that was immunized with H5 but not with H7 type strains only developed a HI response against H5 antigen (Table C-54).

Example 61

Construction of Phage Display Libraries

Total RNA was isolated from about $10^8$ PBLs obtained in example 60 using the RNeasy maxi kit (Qiagen). cDNA synthesis was performed using primer NotI-d(T)18 (Table C-55) and Superscript III reverse transcriptase (Invitrogen). The NANOBODY® ($V_{HH}$ sequence) encoding fragments were amplified by PCR using primer VH2B in combination with either primer lam07, lam08 or BOLI-192 (Table C-55) and Amplitaq Gold DNA polymerase (Applied Biosystems). The PCR fragments were cut with PstI and NotI and ligated to similarly cut phage display vector pRL144 (Harmsen et al. 2005, Vaccine 23: 4926-4934).

By electroporation of *Escherichia coli* TG1 cells twelve libraries were obtained (Table C-56).

Example 62

Phage Display Selections

Phage libraries obtained in Example 61 were rescued by infection with VCS-M13 helperphage and phage particles were purification by two PEG precipitations (McCafferty and Johnson 1996, Construction and screening of antibody display libraries. In: Kay, BK, Winter, J, and McCafferty, J [eds], Phage display of peptides and proteins. Academic Press, San Diego, pp. 79-111). For phage display selections libraries pAL442, 443, 444, 448, 449 and 450 were pooled. Phage pannings were performed in 96-well polystyrene microtiter plates (Greiner) by direct coating of AI antigen. AI antigen had been obtained from propagation of AI strains on Madin Darby canine kidney (MDCK) cells grown in suspension on serum free medium (SFM4BHK21 medium, a prototype medium developed for BHK21 cells obtained from Hyclone) and that was 20-fold concentrated using a 100-kDa molecular weight cutoff centrifugation-concentration device. Alternatively, phage pannings were performed using recombinant his-tagged HAO trimer from H5N1 strain A/Anhui/1/2005 (Abcam, Cambridge, UK; Cat. No. ab53938) or recombinant his-tagged HA1 from H7N7 strain A/Chicken/Netherlands/01/03 (Abcam, Cambridge, UK; Cat. No. ab61286), both produced by HEK293 cells. For this purpose these recombinant antigens were captured in polystyrene microtiter plates coated with 2 μg/ml affinity purified polyclonal rabbit anti-his6 peptide antibody (Rockland, Cat. No. 600-401-382). Alternatively, phage display selections were performed using Drosophila S2 cell produced strep-tagged recombinant haemagglutinin derived from an H7N2 influenza strain (HAstr H7N2). Antigen concentrations used during panning were either 0.1 or 0.01 μg/ml. Phage libraries were added at $10^{10}$ TU per well. Bound phage were eluted by incubation in 1 mg/ml trypsin in PBS buffer for 30 min.

Example 63

Binding to Influenza Antigens in ELISA

Individual clones binding to influenza antigens in ELISA were screened using soluble NANOBODIES® ($V_{HH}$ sequences) prepared according to a previously described protocol (McCafferty, J, and Johnson, K S, 1996, Construction and screening of antibody display libraries. In: Kay, BK, Winter, J, and McCafferty, J [eds], Phage display of peptides and proteins. Academic Press, San Diego, pp. 79-111). The influenza antigens were obtained from virus propagated on MDCK cells using serum free medium and further purified by sucrose density gradients. The authentic AIV antigens used in ELISA originated from the strains indicated in Table C-57.

Briefly, 96-well ELISA plates were coated with 1 μg/ml AIV antigen in 50 mM carbonate/bicarbonate buffer pH 9.6. These plates were then incubated with tenfold diluted *E. coli* culture supernatants in ELISA-buffer (1% skimmed milk; 0.05% Tween-20; 0.5M NaCl; 2.7 mM KCl; 2.8 mM $KH_2PO_4$; 8.1 mM $Na_2HPO_4$; pH 7.4). Bound NANOBODIES® ($V_{HH}$ sequences) were subsequently detected using a peroxidase-conjugated monoclonal antibody against the c-myc tag (Roche Applied Science, Mannheim, Germany) and stained with 3,3',5,5'-tetramethylbenzidine.

After screening individual clones for binding to authentic AIV antigens 39 clones binding to AIV antigens from H5 strains and 50 clones binding to AIV antigen from H7 strains were sequenced. Sequence analysis was performed using the ABI3130 capillary sequencer (Applied Biosystems) and primer MPE26 (Table C-55). The 39 H5 binding clones encoded 25 different NANOBODIES® ($V_{HH}$ sequences) that form six CDR3 groups (Table A-1 and Table C-58). The 50 H7 binding clones encoded 40 different NANOBODIES® ($V_{HH}$ sequences) that form seven CDR3 groups (Table A-1 and Table C-59). With the exception of clone IV28, all H5 and H7 binding clones encoded NANOBODIES® ($V_{HH}$ sequences) containing the hallmark amino acid residues typical of single-domain antibodies (Harmsen et al. 2000, Mol. Immunol. 37: 579-590).

Most H7 binding NANOBODIES® ($V_{HH}$ sequences) of CDR3 group A contain a potential N-glycosylation site at position 84. Most H5 binding clones bind specifically to AIV antigens of three different H5 strains. However, clones of CDR3 group B also bind to antigen of an H1 strain (Table C-58). Furthermore, two clones (IV154 and IV155) that fall into two CDR3 groups bind to AIV antigen of H1, H7 and H5 strains (Table C-58). These clones probably bind to nucleoprotein, which is highly immunogenic and highly conserved between influenza strains of different serotypes. Consistent with this conclusion, these clones were selected in both panning rounds on authentic AIV antigens whereas most other clones were selected using recombinant haemagglutinin in the second round of phage display selection. Almost all 40 H7 binding NANOBODIES® ($V_{HH}$ sequences) bind to AIV antigen of two H7 strains, but not to AIV antigen of H1 or H5 strains (Table C-59). Only clone IV18 appeared to bind to H5 antigen. However, the two clones that encoded NANOBODIES® ($V_{HH}$ sequences) that are identical to IV18 did not show such cross reaction to H5 strains, suggesting that this cross reaction is an artifact.

Example 64

Yeast Expression of Selected NANOBODIES® ($V_{HH}$ Sequences)

We selected eight H5 binding NANOBODIES® ($V_{HH}$ sequences) and eight H7 binding NANOBODIES® ($V_{HH}$ sequences) for small scale yeast (*Saccharomyces cerevisiae*) expression using plasmid pRL188 (Harmsen et al. 2007, Vet. Microbiol. 120: 193-206). This plasmid results in NANOBODY® ($V_{HH}$ sequence) production with a C-terminal extension with amino acid sequence (SEQ ID NO: 3063; EPKTPKPQPQPQPQPQPNPTTESKCPHHHHHH). We preferably selected clones representing all CDR3 groups for such yeast expression. Insertion of the NANOBODY® ($V_{HH}$ sequence) coding sequence into pRL188 required the presence of a BstEII restriction endonuclease cleavage site in the FR4 coding region. This site was present in most NANOBODY® ($V_{HH}$ sequence) clones, but not in all (Tables C-58 and C-59). As a result we could not yeast-produce IV151 and IV153, which are unique representatives of two CDR3 groups, in a *facile* manner. A person skilled in the art could produce such clones suitable for yeast expression by introduction of this BstEII site by site-directed mutagenesis. Furthermore, the subcloning of IV28 into pRL188 was not successful. NANOBODIES® ($V_{HH}$ sequences) were expressed in *S. cerevisiae* under control of the GALT promoter and directed into the growth medium by fusion to the invertase signal peptide as described previously (Harmsen et al. 2007, Vet. Microbiol. 120: 193-206 and references therein). The NANOBODIES® ($V_{HH}$ sequences) were purified from culture supernatant using immobilized-metal affinity chromatography. Purified NANOBODIES® ($V_{HH}$ sequences) were concentrated and the buffer exchanged to phosphate-buffered saline by use of 5-kDa molecular weight cut-off centrifugal concentration devices (Biomax-5 membrane, Millipore, Bedford, Mass.). The protein concentration was determined using the Bio-Rad (Hercules, Calif.) protein assay.

Example 65

Characteristics of Yeast-Produced NANOBODIES® ($V_{HH}$ Sequences)

65.1

Binding in ELISA

Figure 66:
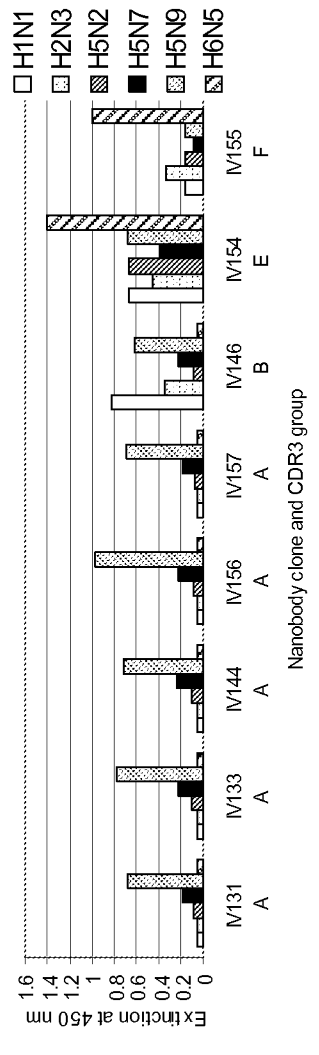
FIG. 66: Binding of yeast-produced NANOBODIES® ($V_{HH}$ sequences) to authentic antigens of different influenza strains (see Table C-57). Clones in panel A and B were selected for binding to H5 strains whereas clones in panel C and D were selected for binding to H7 strains. ELISA plates coated with 5 μg/ml influenza antigens were incubated with 10 μg/ml NANOBODY® ($V_{HH}$ sequence) that was subsequently detected using an anti-his6 peroxidase conjugate.
Figure 66:
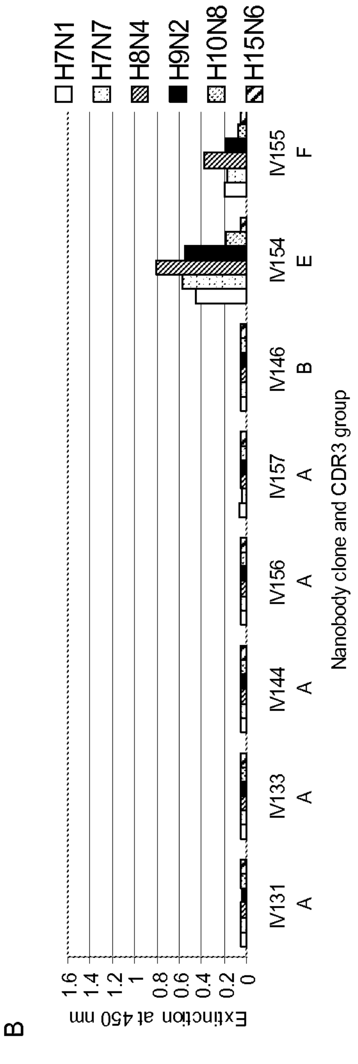
Figure 66:
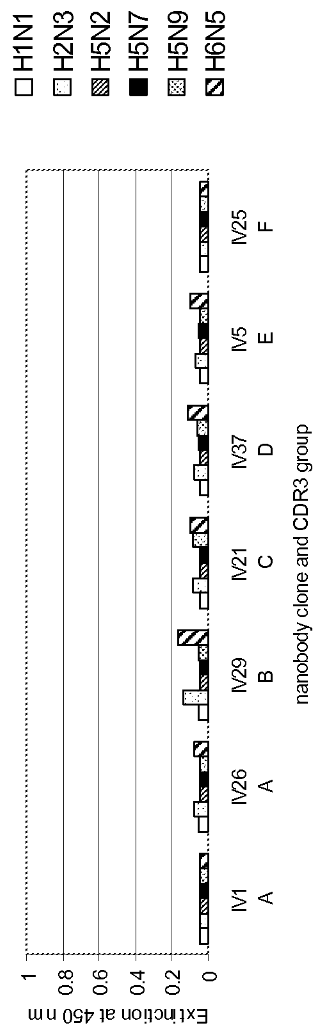
Figure 66:
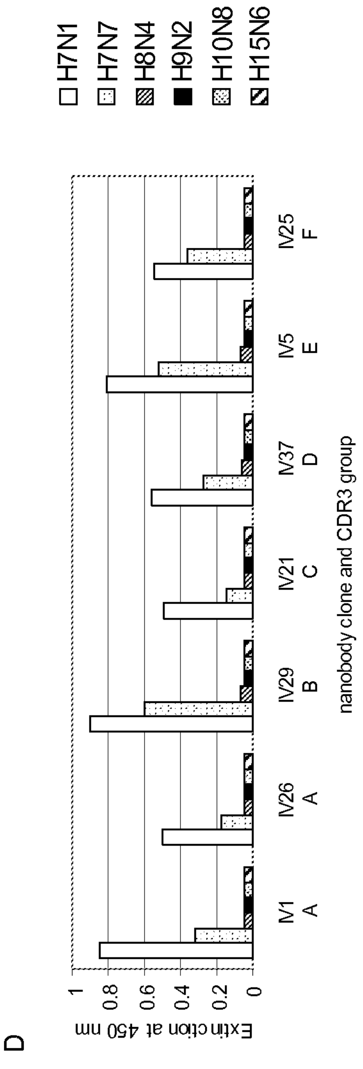

We next analysed the binding of the selected NANOBODIES® ($V_{HH}$ sequences) to influenza antigens of strains of different serotypes. This ELISA was essentially performed as described in the previous section (Example 63) for screening of *E. coli* produced NANOBODIES® ($V_{HH}$ sequences) but using a higher concentration of influenza antigen (see Table C-57) for coating (5 μg/ml) and using a peroxidase-conjugated anti-his6 monoclonal antibody (Roche Applied Science) for NANOBODY® ($V_{HH}$ sequence) detection. The NANOBODIES® ($V_{HH}$ sequences) that were selected for binding to H5 strains all react with all three H5 strains used (FIG. 66A). The five NANOBODIES® ($V_{HH}$ sequences) of CDR3 group A did not cross react with strains of other H serotypes (FIGS. 66A and B). The single NANOBODY® ($V_{HH}$ sequence) of CDR3 group B (IV146) cross reacted only with H1 and H2 strains (FIGS. 66A and B). The NANOBODIES® ($V_{HH}$ sequences) IV154 and IV155, representing two CDR3 groups, cross reacted with all strains except H15N6 (FIGS. 66A and B). The NANOBODIES® ($V_{HH}$ sequences) selected for binding to H7 strains all could bind to both H7 strains (FIG. 66D). Two NANOBODIES® ($V_{HH}$ sequences) (IV1 and IV25) did not cross react to other strains whereas the other five nanobodies NANOBODIES® ($V_{HH}$ sequences) (IV5, IV21, IV26, IV29 and IV37) showed weak cross reaction with an H2N3 and an H6N5 strain (FIGS. 66C and D). These results of the yeast-produced NANOBODIES® ($V_{HH}$ sequences) are consistent with the results of the *E. coli* produced NANOBODIES® ($V_{HH}$ sequences) (Tables C-58 and C-59).

We next analysed the binding of NANOBODIES® ($V_{HH}$ sequences) to selected authentic and recombinant antigens in ELISA by incubation of twofold dilution series of NANOBODIES® ($V_{HH}$ sequences) with a starting concentration of 10 μg/ml. NANOBODIES® ($V_{HH}$ sequences) bound to recombinant antigens were detected using a polyclonal rabbit anti-NANOBODY® ($V_{HH}$ sequence) serum (R907) and peroxidase-conjugated swine anti-rabbit serum (Dako, P217) since the recombinant antigen also contains a his6 tag. After nonlinear regression analysis the NANOBODY® ($V_{HH}$ sequence) concentration required to obtain an extinction at 450 nm of 0.2 (authentic antigens) or 1.0 (recombinant antigens) was interpolated. All NANOBODIES® ($V_{HH}$ sequences) selected for binding to H5 strains could bind to H5N9 antigen with titers differing at most 5-fold (Table C-60). Six clones also could bind to two recombinant H5 antigens (Table C-60), demonstrating that they recognized haemagglutinin. Two further clones (IV154 and IV155) did not bind to both recombinant haemagglutinins at all. This further suggests that these clones bind to nucleoprotein, as suggested above based on their binding to authentic influenza antigens of many different H and N types. The NANOBODIES® ($V_{HH}$ sequences) selected for binding to H7 strains all could bind to authentic antigen of two H7 type influenza strains and recombinant HA1 fragment (Table C-61), showing that they bind to haemagglutinin.

65.2

Virus Neutralization

We next determined the in vitro virus neutralizing capacity of the selected NANOBODIES® ($V_{HH}$ sequences). For this purpose 100 tissue culture infective doses required to infect 50% of the wells ($TCID_{50}$) were preincubated with twofold dilution series of yeast-produced NANOBODIES® ($V_{HH}$ sequences) for 1 hour at room temperature. These were subsequently added to MDCK cell monolayers in a serum free medium containing 3 μg/ml trypsin to enable virus replication. After two days of growth at 37° C. and 5% $CO_2$ influenza virus antigen in the wells was detected using an immunoperoxidase monolayer assay employing a nucleoprotein specific monoclonal antibody (HB65, also known as H16-L10-4; Yewdell et al. 1981, J. Immunol. 126: 1814-1819). Neutralization titers were calculated according to Reed and Muench (1938, Am. J. Hyg. 27: 493). Only clone IV146 could neutralize both H5 type viruses at the lowest concentration analysed (0.75 μg/ml), whereas all other NANOBODIES® ($V_{HH}$ sequences) did not neutralize the two virus strains used at the highest concentration analysed of 50 μg/ml (Tables C-60 and C-61).

65.3

Inhibition of Hemagglutination

We similarly determined the ability of the yeast-produced NANOBODIES® ($V_{HH}$ sequences) to inhibit haemagglutination using the protocol described (Example 60) above for analysis of llama sera. We could not detect any inhibition of haemagglutination at the highest NANOBODY® ($V_{HH}$ sequence) concentration analysed (Tables C-60 and C-61).

Thus, clone IV146 neutralizes influenza virus without inhibiting haemagglutination. This is an unexpected finding since most previously isolated conventional monoclonal antibodies that neutralize influenza virus also inhibit haemagglutination. Clone IV146 also cross reacts in ELISA with H1 and H2 strains. This is again unexpected, since most conventional monoclonal antibodies binding haemagglutinin bind specifically to one haemagglutinin type. However, recently, H5 type haemagglutinin binding human monoclonal antibodies that cross react to H1 and H2 type strains, and neutralize virus without inhibiting haemagglutination were found by several groups (Throsby et al. 2008, Plos ONE 3; Sui et al. Nature Struct. Biol. 16: 265-273; Kashyap et al. 2008, Proc. Nat. Acad. Sci. 22: 5986-5991). These human mAbs bind to a relatively conserved epitope mainly present on the HA2 domain that is involved in initiating the fusion of the viral and host cell membranes, which is essential for infection. This epitope can be present in two conformations: a prefusion state which does not enable membrane fusion and another conformation that is competent for membrane fusion. The prefusion state is recognized by such broadly cross reactive neutralizing antibodies (Sui et al. Nature Struct. Biol. 16: 265-273; Ekiert et al., 2009, Science 324: 246-251), suggesting that the mechanism of virus neutralization by such antibodies relies on inhibition of a conformational change of HA into a conformation competent for fusion. The similarity in virus neutralization and strain specificity of IV146 with these human monoclonal antibodies suggests that IV146 also recognizes this conserved epitope on the HA2 domain that is involved in initiating membrane fusion.

Tables

TABLE A-2

Amino acid sequence of multivalent constructs that bind hRSV (including Myc-His tag

| Construct | SEQ ID NO | Sequence |
|---|---|---|
| RSV101 | 2382 | EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGGSGGGGSEVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSAAAEQKLISEEDLNGAAHHHHHH |
| RSV102 | 2383 | VQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGGSGGGGSGGGGSGGGGSEVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSAAAEQKLISEEDLNGAAHHHHHH |

TABLE A-2-continued

Amino acid sequence of multivalent constructs that bind hRSV (including Myc-His tag

| Construct | SEQ ID NO | Sequence |
|---|---|---|
| RSV103 | 2384 | EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGGSGGGGSGGGGSGGGGSGGGGSGGGGSEVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSAAAEQKLISEEDLNGAAHHHHHH |
| RSV104 | 2385 | EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGSEVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSAAAEQKLISEEDLNGAAHHHHHH |
| RSV105 | 2386 | EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSAAAEQKLISEEDLNGAAHHHHHH |
| RSV106 | 2387 | EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSAAAEQKLISEEDLNGAAHHHHHH |
| RSV107 | 2388 | EVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSSGGGGSGGGSEVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSSAAAEQKLISEEDLNGAAHHHHHH |
| RSV108 | 2389 | EVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSSGGGGSGGGGSGGGGSEVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSSAAAEQKLISEEDLNGAAHHHHHH |
| RSV109 | 2390 | EVQLVESGGGLVQPGGSLRLSCAASGRTFSSIAMGWFRQAPGKEREFVAAISWSRGRTFYADSVKGRFIISRDDAANTAYLQMNSLKPEDTAVYYCAVDTASWNSGSFIYDWAYDHWGQGTQVTVSSGGGGSGGGSEVQLVESGGGLVQPGGSLRLSCAASGRTFSSIAMGWFRQAPGKEREFVAAISWSRGRTFYADSVKGRFIISRDDAANTAYLQMNSLKPEDTAVYYCAVDTASWNSGSFIYDWAYDHWGQGTQVTVSSAAAEQKLISEEDLNGAAHHHHHH |
| RSV110 | 2391 | EVQLVESGGGLVQPGGSLRLSCAASGRTFSSIAMGWFRQAPGKEREFVAAISWSRGRTFYADSVKGRFIISRDDAANTAYLQMNSLKPEDTAVYYCAVDTASWNSGSFIYDWAYDHWGQGTQVTVSSGGGGSGGGGSGGGGSEVQLVESGGGLVQPGGSLRLSCAASGRTFSSIAMGWFRQAPGKEREFVAAISWSRGRTFYADSVKGRFIISRDDAANTAYLQMNSLKPEDTAVYYCAVDTASWNSGSFIYDWAYDHWGQGTQVTVSSAAAEQKLISEEDLNGAAHHHHHH |
| RSV113 | 2392 | EVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSSGGGGSGGGGSGGGGSEVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSSAAAEQKLISEEDLNGAAHHHHHH |
| RSV114 | 2393 | EVQLVESGGGWVQAGGSLRLSCAASGRAFSSYAMGWIRQAPGKEREFVAGIDQSGESTAYGASASGRFIISRDNAKNTVHLLMNSLQSDDTAVYYCVADGVLATTLNWDYWGQGTQVTVSSGGGGSGGGGSGGGGSGGGGSEVQLVESGGGWVQAGGSLRLSCAASGRAFSSYAMGWIRQAPGKEREFVAGIDQSGESTAYGASASGRFIISRDNAKNTVHLLMNSLQSDDTAVYYCVADGVLATTLNWDYWGQGTQVTVSSAAAEQKLISEEDLNGAAHHHHHH |
| RSV115 | 2394 | EVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSSGGGGSGGGGSGGGGGGGSEVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSSAAAEQKLISEEDLNGAAHHHHHH |
| RSV116 | 2395 | EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGGSGGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSAAAEQKLISEEDLNGAAHHHHHH |

TABLE A-2-continued

Amino acid sequence of multivalent constructs that bind hRSV (including Myc-His tag

| Construct | SEQ ID NO | Sequence |
| --- | --- | --- |
| RSV201 | 2396 | EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGSEVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSSAAAEQKLISEEDLNGAAHHHHHH |
| RSV202 | 2397 | EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGGSGGGGSEVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSSAAAEQKLISEEDLNGAAHHHHHH |
| RSV203 | 2398 | EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGGSGGGGSGGGGSGGGGSEVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSSAAAEQKLISEEDLNGAAHHHHHH |
| RSV204 | 2399 | EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSSAAAEQKLISEEDLNGAAHHHHHH |
| RSV205 | 2400 | EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSSAAAEQKLISEEDLNGAAHHHHHH |
| RSV206 | 2401 | EVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSAAAEQKLISEEDLNGAAHHHHHH |
| RSV207 | 2402 | EVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSAAAEQKLISEEDLNGAAHHHHHH |
| RSV301 | 2403 | EVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSSGGGGSGGGSEVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSAAAEQKLISEEDLNGAAHHHHHH |
| RSV302 | 2404 | EVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSSGGGGSGGGGSGGGGSEVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSAAAEQKLISEEDLNGAAHHHHHH |
| RSV303 | 2405 | EVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSSGGGGSGGGGSGGGGSGGGGSGGGGSEVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSAAAEQKLISEEDLNGAAHHHHHH |
| RSV305 | 2406 | EVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSAAAEQKLISEEDLNGAAHHHHHH |
| RSV306 | 2407 | EVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSSGGGGSGGGGSGGGGSEVQLVESGGGLVQAGGSLRLSCAASGRSFSNYV |

TABLE A-2-continued

Amino acid sequence of multivalent constructs that bind hRSV (including Myc-His tag

| Construct | SEQ ID NO | Sequence |
|---|---|---|
| | | LGWFRQAPGKEREFVAAISFRGDSAIGAPSVEGRFTISRDNAKNTGYLQMNSLVPDDT AVYYCGAGTPLNPGAYIYDWSYDYWGRGTQVTVSSAAAEQKLISEEDLNGAAHHHHHH |
| RSV400 | 2408 | EVQLVESGGGLVQAGDSLRLSCAASGRTFSSYAMGWFRQAPGKEREFVAAISWSDGST YYADSVKGRFTISRDNAKNTVYLQMNSLKPEDTAVYYCAADLTSTNPGSYIYIWAYDY WGQGTQVTVSSGGGGSGGGGSGGGGSEVQLVESGGGLVQAGDSLRLSCAASGRTFSSY AMGWFRQAPGKEREFVAAISWSDGSTYYADSVKGRFTISRDNAKNTVYLQMNSLKPED TAVYYCAADLTSTNPGSYIYIWAYDYWGQGTQVTVSSGGGGSGGGGSGGGGSEVQLVE SGGGLVQAGDSLRLSCAASGRTFSSYAMGWFRQAPGKEREFVAAISWSDGSTYYADSV KGRFTISRDNAKNTVYLQMNSLKPEDTAVYYCAADLTSTNPGSYIYIWAYDYWGQGTQ VTVSSAAAEQKLISEEDLNGAAHHHHHH |
| RSV401 | 2409 | EVQLVESGGGLVQAGDSLRLSCAASGRTFSSYAMGWFRQAPGKEREFVAAISWSDGST YYADSVKGRFTISRDNAKNTVYLQMNSLKPEDTAVYYCAADLTSTNPGSYIYIWAYDY WGQGTQVTVSSGGGGSGGGGSGGGGSEVQLVESGGGLVQAGDSLRLSCAASGRTFSSY AMGWFRQAPGKEREFVAAISWSDGSTYYADSVKGRFTISRDNAKNTVYLQMNSLKPED TAVYYCAADLTSTNPGSYIYIWAYDYWGQGTQVTVSSGGGGSGGGGSGGGGSEVQLVE SGGGLVQPGGSLRLSCAASGLTLDYYALGWFRQAPGKEREGVSCISSSDHSTTYTDSV KGRFTISWDNAKNTLYLQMNSLKPGDTAVYYCAADPALGCYSGSYYPRYDYWGQGTQV TVSSAAAEQKLISEEDLNGAAHHHHHH |
| RSV402 | 2410 | EVQLVESGGGLVQPGGSLRLSCAASGLTLDYYALGWFRQAPGKEREGVSCISSSDHST TYTDSVKGRFTISWDNAKNTLYLQMNSLKPGDTAVYYCAADPALGCYSGSYYPRYDYW GQGTQVTVSSGGGGSGGGGSGGGGSEVQLVESGGGLVQAGDSLRLSCAASGRTFSSYA MGWFRQAPGKEREFVAAISWSDGSTYYADSVKGRFTISRDNAKNTVYLQMNSLKPEDT AVYYCAADLTSTNPGSYIYIWAYDYWGQGTQVTVSSGGGGSGGGGSGGGGSEVQLVES GGGLVQAGDSLRLSCAASGRTFSSYAMGWFRQAPGKEREFVAAISWSDGSTYYADSVK GRFTISRDNAKNTVYLQMNSLKPEDTAVYYCAADLTSTNPGSYIYIWAYDYWGQGTQV TVSSAAAEQKLISEEDLNGAAHHHHHH |
| RSV403 | 2411 | EVQLVESGGGLVQAGDSLRLSCAASGRTFSSYAMGWFRQAPGKEREFVAAISWSDGST YYADSVKGRFTISRDNAKNTVYLQMNSLKPEDTAVYYCAADLTSTNPGSYIYIWAYDY WGQGTQVTVSSGGGGSGGGGSGGGGSEVQLVESGGGLVQPGGSLRLSCAASGLTLDYY ALGWFRQAPGKEREGVSCISSSDHSTTYTDSVKGRFTISWDNAKNTLYLQMNSLKPGD TAVYYCAADPALGCYSGSYYPRYDYWGQGTQVTVSSGGGGSGGGGSGGGGSEVQLVES GGGLVQAGDSLRLSCAASGRTFSSYAMGWFRQAPGKEREFVAAISWSDGSTYYADSVK GRFTISRDNAKNTVYLQMNSLKPEDTAVYYCAADLTSTNPGSYIYIWAYDYWGQGTQV TVSSAAAEQKLISEEDLNGAAHHHHHH |
| RSV404 | 2412 | EVQLVESGGGLVQAGGSLRLSCAASGRSFSNYVLGWFRQAPGKEREFVAAISFRGDSA IGAPSVEGRFTISRDNAKNTGYLQMNSLVPDDTAVYYCGAGTPLNPGAYIYDWSYDYW GRGTQVTVSSGGGGSGGGGSGGGGSEVQLVESGGGLVQAGGSLRLSCAASGRSFSNYV LGWFRQAPGKEREFVAAISFRGDSAIGAPSVEGRFTISRDNAKNTGYLQMNSLVPDDT AVYYCGAGTPLNPGAYIYDWSYDYWGRGTQVTVSSGGGGSGGGGSGGGGSEVQLVESG GGLVQAGGSLRLSCAASGRSFSNYVLGWFRQAPGKEREFVAAISFRGDSAIGAPSVEG RFTISRDNAKNTGYLQMNSLVPDDTAVYYCGAGTPLNPGAYIYDWSYDYWGRGTQVTV SSAAAEQKLISEEDLNGAAHHHHHH |
| RSV405 | 2413 | EVQLVESGGGLVQAGGSLRLSCEASGRTYSRYGMGWFRQAPGKEREFVAAVSRLSGPR TVYADSVKGRFTISRDNAENTVYLQMNSLKPEDTAVYTCAAELTNRNSGAYYYAWAYD YWGQGTQVTVSSGGGGSGGGGSGGGGSEVQLVESGGGLVQAGGSLRLSCEASGRTYSR YGMGWFRQAPGKEREFVAAVSRLSGPRTVYADSVKGRFTISRDNAENTVYLQMNSLKP EDTAVYTCAAELTNRNSGAYYYAWAYDYWGQGTQVTVSSGGGGSGGGGSGGGGSEVQL VESGGGLVQAGGSLRLSCEASGRTYSRYGMGWFRQAPGKEREFVAAVSRLSGPRTVYA DSVKGRFTISRDNAENTVYLQMNSLKPEDTAVYTCAAELTNRNSGAYYYAWAYDYWGQ GTQVTVSSAAAEQKLISEEDLNGAAHHHHHH |
| RSV406 | 2414 | EVQLVESGGGLVQPGGSLRLSCAASGRTFSSIAMGWFRQAPGKEREFVAAISWSRGRT FYADSVKGRFIISRDDAANTAYLQMNSLKPEDTAVYYCAVDTASWNSGSFIYDWAYDH WGQGTQVTVSSGGGGSGGGGSGGGGSEVQLVESGGGLVQPGGSLRLSCAASGRTFSSI AMGWFRQAPGKEREFVAAISWSRGRTFYADSVKGRFIISRDDAANTAYLQMNSLKPED TAVYYCAVDTASWNSGSFIYDWAYDHWGQGTQVTVSSGGGGSGGGGSGGGGSEVQLVE SGGGLVQPGGSLRLSCAASGRTFSSIAMGWFRQAPGKEREFVAAISWSRGRTFYADSV KGRFIISRDDAANTAYLQMNSLKPEDTAVYYCAVDTASWNSGSFIYDWAYDHWGQGTQ VTVSSAAAEQKLISEEDLNGAAHHHHHH |
| RSV407 | 2415 | EVQLVESGGGLVQAGGSLSISCAASGGSLSNYVLGWFRQAPGKEREFVAAINWRGDIT IGPPNVEGRFTISRDNAKNTGYLQMNSLAPDDTAVYYCGAGTPLNPGAYIYDWSYDYW GRGTQVTVSSGGGGSGGGGSGGGGSEVQLVESGGGLVQAGGSLSISCAASGGSLSNYV LGWFRQAPGKEREFVAAINWRGDITIGPPNVEGRFTISRDNAKNTGYLQMNSLAPDDT AVYYCGAGTPLNPGAYIYDWSYDYWGRGTQVTVSSGGGGSGGGGSGGGGSEVQLVESG GGLVQAGGSLSISCAASGGSLSNYVLGWFRQAPGKEREFVAAINWRGDITIGPPNVEG |

TABLE A-2-continued

Amino acid sequence of multivalent constructs that bind hRSV (including Myc-His tag

| Construct | SEQ ID NO | Sequence |
|---|---|---|
| | | RFTISRDNAKNTGYLQMNSLAPDDTAVYYCGAGTPLNPGAYIYDWSYDYWGRGTQVTVSSAAAEQKLISEEDLNGAAHHHHHH |
| RSV408 | 2989 | EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSAAAEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSAAAEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSAAAEQKLISEEDLNGAAHHHHHH |
| RSV409 | 2990 | EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSAAAEQKLISEEDLNGAAHHHHHH |
| RSV410 | 2991 | EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGGSGGGGSGGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGGSGGGGSGGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSAAAEQKLISEEDLNGAAHHHHHH |
| RSV411 | 2992 | EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGGSGGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGGSGGGGSEVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSSAAAEQKLISEEDLNGAAHHHHHH |
| RSV412 | 2993 | EVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSSGGGGSGGGGSGGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGGSGGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSAAAEQKLISEEDLNGAAHHHHHH |
| RSV413 | 2994 | EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGGSGGGGSEVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSSGGGGSGGGGSGGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSAAAEQKLISEEDLNGAAHHHHHH |
| RSV502 | 2995 | EVQLVESGGGLVQAGGSLRLSCEASGRTFSSYGMGWFRQAPGKEREFVAAVSRLSGPRTVYADSVKGRFTISRDNAENTVYLQMNSLKPEDTAVYTCAAELTNRNPGAYYYTWAYDYWGQGTQVTVSSGGGGSGGGGSGGGGSEVQLVESGGGLVQAGGSLRLSCEASGRTFSSYGMGWFRQAPGKEREFVAAVSRLSGPRTVYADSVKGRFTISRDNAENTVYLQMNSLKPEDTAVYTCAAELTNRNPGAYYYTWAYDYWGQGTQVTVSSGGGGSGGGGSGGGGSEVQLVESGGGLVQAGGSLRLSCEASGRTFSSYGMGWFRQAPGKEREFVAAVSRLSGPRTVYADSVKGRFTISRDNAENTVYLQMNSLKPEDTAVYTCAAELTNRNPGAYYYTWAYDYWGQGTQVTVSSAAAEQKLISEEDLNGAAHHHHHH |
| RSV513 | 3584 | EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQPGGSLRLSCAASGLTLDYYALGWFRQAPGKEREGVSCISSSDHTTTYTDSVKGRFTISWDNAKNTLYLQMNSLKPEDTAVYYCAADPALGCYSGSYYPRYDFWGQGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSAAAEQKLISEEDLNGAAHHHHHH |

TABLE A-2-continued

Amino acid sequence of multivalent constructs that bind hRSV (including Myc-His tag

| Construct | SEQ ID NO | Sequence |
|---|---|---|
| RSV514 | 3585 | EVQLVESGGGLVQAGDSLRLSCAASGRTFSSYAMGWFRQAPGKEREFVAAISWSDGST YYADSVKGRFTISRDNAKNTVYLQMNSLKPEDTAVYYCAADLTSTNPGSYIYIWAYDY WGQGTQVTVSSGGGGSGGGSEVQLVESGGGLVQPGGSLRLSCAASGLTLDYYALGWFR QAPGKEREGVSCISSSDHTTTYTDSVKGRFTISWDNAKNTLYLQMNSLKPEDTAVYYC AADPALGCYSGSYYPRYDFWGQGTQVTVSSGGGGSGGGSEVQLVESGGGLVQAGDSLR LSCAASGRTFSSYAMGWFRQAPGKEREFVAAISWSDGSTYYADSVKGRFTISRDNAKN TVYLQMNSLKPEDTAVYYCAADLTSTNPGSYIYIWAYDYWGQGTQVTVSSAAAEQKLI SEEDLNGAAHHHHHH |
| RSV515 | 3586 | EVQLVESGGGLVQAGDSLRLSCAASGRTFSSYAMGWFRQAPGKEREFVAAISWSDGST YYADSVKGRFTISRDNAKNTVYLQMNSLKPEDTAVYYCAADLTSTNPGSYIYIWAYDY WGQGTQVTVSSGGGGSGGGGSGGGGSEVQLVESGGGLVQPGGSLRVSCAASGFTFNDY IMGWFRQAPGKERMFIAAISGTGTIKYYGDLVRGRFTISRDNAKNTVYLRIDSLNPED TAVYYCAARQDYGLGYRESHEYDYWGQGTQVTVSSGGGGSGGGGSGGGGSEVQLVESG GGLVQAGDSLRLSCAASGRTFSSYAMGWFRQAPGKEREFVAAISWSDGSTYYADSVKG RFTISRDNAKNTVYLQMNSLKPEDTAVYYCAADLTSTNPGSYIYIWAYDYWGQGTQVT VSSAAAEQKLISEEDLNGAAHHHHHH |
| RSV516 | 3587 | EVQLVESGGGLVQAGDSLRLSCAASGRTFSSYAMGWFRQAPGKEREFVAAISWSDGST YYADSVKGRFTISRDNAKNTVYLQMNSLKPEDTAVYYCAADLTSTNPGSYIYIWAYDY WGQGTQVTVSSGGGGSGGGSEVQLVESGGGLVQPGGSLRVSCAASGFTFNDYIMGWFR QAPGKERMFIAAISGTGTIKYYGDLVRGRFTISRDNAKNTVYLRIDSLNPEDTAVYYC AARQDYGLGYRESHEYDYWGQGTQVTVSSGGGGSGGGSEVQLVESGGGLVQAGDSLRL SCAASGRTFSSYAMGWFRQAPGKEREFVAAISWSDGSTYYADSVKGRFTISRDNAKNT VYLQMNSLKPEDTAVYYCAADLTSTNPGSYIYIWAYDYWGQGTQVTVSSAAAEQKLIS EEDLNGAAHHHHHH |

TABLE A-3

F-protein sequences

| F-protein | SEQ ID NO | Sequence |
|---|---|---|
| RSV LONG M-2 | 2416 | MELPILKANAITTILAAVTFCFASSQNITEEFYQSTCSAVSKG YLSALRTGWYTSVITIELSNIKENKCNGTDAKVKLIKQELDKY KNAVTELQLLMQSTPAANNRARRELPRFMNYTLNNTKKTNVTL SKKRKRRFLGFLLGVGSAIASGTAVSKVLHLEGEVNKIKSALL STNKAVVSLSNGVSVLTSKVLDLKNYIDKQLLPIVNKQSCRIS NIETVIEFQQKNNRLLEITREFSVNAGVTTPVSTYMLTNSELL SLINDMPITNDQKKLMSNNVQIVRQQSYSIMSIIKEEVLAYVV QLPLYGVIDTPCWKLHTSPLCTTNTKEGSNICLTRTDRGWYCD NAGSVSFFPQAETCKVQSNRVFCDTMNSLTLPSEVNLCNVDIF NPKYDCKIMTSKTDVSSSVITSLGAIVSCYGKTKCTASNKNRG IIKTFSNGCDYVSNKGVDTVSVGNTLYYVNKQEGKSLYVKGEP IINFYDPLVFPSDEFDASISQVNEKINQSLAFIRKSDELLHHV NAGKSTTNIMITTIIIVIIVILLSLIAVGLLLYCKARSTPVTL SKDQLSGINNIAFSN |
| RSV A-2 | 2417 | MELLILKANAITTILTAVTFCFASGQNITEEFYQSTCSAVSKG YLSALRTGWYTSVITIELSNIKKNKCNGTDAKVKLIKQELDKY KNAVTELQLLMQSTQATNNRARRELPRFMNYTLNNAKKTNVTL SKKRKRRFLGFLLGVGSAIASGVAVSKVLHLEGEVNKIKSALL STNKAVVSLSNGVSVLTSKVLDLKNYIDKQLLPIVNKQSCSIS NIETVIEFQQKNNRLLEITREFSVNAGVTTPVSTYMLTNSELL SLINDMPITNDQKKLMSNNVQIVRQQSYSIMSIIKEEVLAYVV QLPLYGVIDTPCWKLHTSPLCTTNTKEGSNICLTRTDRGWYCD NAGSVSFFPQAETCKVQSNRVFCDTMNSLTLPSEVNLCNVDIF NPKYDCKIMTSKTDVSSSVITSLGAIVSCYGKTKCTASNKNRG IIKTFSNGCDYVSNKGVDTVSVGNTLYYVNKQEGKSLYVKGEP IINFYDPLVFPSDEFDASISQVNEKINQSLAFIRKSDELLHNV NAGKSTTNIMITTIIIVIIVILLSLIAVGLLLYCKARSTPVTL SKDQLSGINNIAFSN |
| RSV B-1 | 2418 | MELLIHRSSAIFLTLAVNALYLTSSQNITEEFYQSTCSAVSRG YFSALRTGWYTSVITIELSNIKETKCNGTDTKVKLIKQELDKY KNAVTELQLLMQNTPAANNRARREAPQYMNYTINTTKNLNVSI SKKRKRRFLGFLLGVGSAIASGIAVSKVLHLEGEVNKIKNALL STNKAVVSLSNGVSVLTSKVLDLKNYINNRLLPIVNQQSCRIS NIETVIEFQQMNSRLLEITREFSVNAGVTTPLSTYMLTNSELL |

TABLE A-3-continued

| F-protein sequences | | |
|---|---|---|
| F-protein | SEQ ID NO | Sequence |
| | | SLINDMPITNDQKKLMSSNVQIVRQQSYSIMSIIKEEVLAYVV QLPIYGVIDTPCWKLHTSPLCTTNIKEGSNICLTRTDRGWYCD NAGSVSFFPQADTCKVQSNRVFCDTMNSLTLPSEVSLCNTDIF NSKYDCKIMTSKTDISSSVITSLGAIVSCYGKTKCTASNKNRG IIKTFSNGCDYVSNKGVDTVSVGNTLYYVNKLEGKNLYVKGEP IINYYDPLVFPSDEFDASISQVNEKINQSLAFIRRSDELLHNV NTGKSTTNIMITTIIIVIIVVLLLLIAIGLLLYCKAKNTPVTL SKDQLSGINNIAFSK |

TABLE A-4

| Amino acid sequence of multivalent constructs that bind hemagglutinin H5 of influenza | | |
|---|---|---|
| Construct | SEQ ID NO | Sequence |
| 202-C8-9GS-202-C8 | 2423 | EVQLVESGGGLVQPGGSLRLSCTGSGFTFSSYWMDWVRQTPGKDLEYVSG ISPSGSNTDYADSVKGRFTISRDNAKNTLYLQMNSLKPEDTALYYCRRSL TLTDSPDLRSQGTQVTVSSGGGSGGGGSEVQLVESGGGLVQPGGSLRLSC TGSGFTFSSYWMDWVRQTPGKDLEYVSGISPSGSNTDYADSVKGRFTISR DNAKNTLYLQMNSLKPEDTALYYCRRSLTLTDSPDLRSQGTQVTVSS |
| 202-C8-15GS-202-C8 | 2424 | EVQLVESGGGLVQPGGSLRLSCTGSGFTFSSYWMDWVRQTPGKDLEYVSG ISPSGSNTDYADSVKGRFTISRDNAKNTLYLQMNSLKPEDTALYYCRRSL TLTDSPDLRSQGTQVTVSSGGGGSGGGGSGGGGSEVQLVESGGGLVQPGG SLRLSCTGSGFTFSSYWMDWVRQTPGKDLEYVSGISPSGSNTDYADSVKG RFTISRDNAKNTLYLQMNSLKPEDTALYYCRRSLTLTDSPDLRSQGTQVT VSS |
| 202-C8-10GS-202-C8-10GS-202-C8 | 2425 | EVQLVESGGGLVQPGGSLRLSCTGSGFTFSSYWMDWVRQTPGKDLEYVSG ISPSGSNTDYADSVKGRFTISRDNAKNTLYLQMNSLKPEDTALYYCRRSL TLTDSPDLRSQGTQVTVSSGGGGSGGGGSEVQLVESGGGLVQPGGSLRLS CTGSGFTFSSYWMDWVRQTPGKDLEYVSGISPSGSNTDYADSVKGRFTIS RDNAKNTLYLQMNSLKPEDTALYYCRRSLTLTDSPDLRSQGTQVTVSSGG GGSGGGGSEVQLVESGGGLVQPGGSLRLSCTGSGFTFSSYWMDWVRQTPG KDLEYVSGISPSGSNTDYADSVKGRFTISRDNAKNTLYLQMNSLKPEDTA LYYCRRSLTLTDSPDLRSQGTQVTVSS |
| 202-C8-20GS-202-C8-20GS-202-C8 | 2426 | EVQLVESGGGLVQPGGSLRLSCTGSGFTFSSYWMDWVRQTPGKDLEYVSG ISPSGSNTDYADSVKGRFTISRDNAKNTLYLQMNSLKPEDTALYYCRRSL TLTDSPDLRSQGTQVTVSSGGGGSGGGGSGGGGSGGGGSEVQLVESGGGL VQPGGSLRLSCTGSGFTFSSYWMDWVRQTPGKDLEYVSGISPSGSNTDYA DSVKGRFTISRDNAKNTLYLQMNSLKPEDTALYYCRRSLTLTDSPDLRSQ GTQVTVSSGGGGSGGGGSGGGGSGGGGSEVQLVESGGGLVQPGGSLRLSC TGSGFTFSSYWMDWVRQTPGKDLEYVSGISPSGSNTDYADSVKGRFTISR DNAKNTLYLQMNSLKPEDTALYYCRRSLTLTDSPDLRSQGTQVTVSS |
| 203-B12-15GS-203-B12 | 2428 | EVQLVESGGGLVQPGGSLRLSCAASGFTFSSYAMGWVRRAPGEGLEWVSS ISSGGALPTYADSVKGRFTISRDNVKNTLYLQMNSLKPEDTAVYSCEKYA GSMWTSERDAWGQGTQVTVSSGGGGSGGGGSGGGGSEVQLVESGGGLVQP GGSLRLSCAASGFTFSSYAMGWVRRAPGEGLEWVSSISSGGALPTYADSV KGRFTISRDNVKNTLYLQMNSLKPEDTAVYSCEKYAGSMWTSERDAWGQG TQVTVSS |
| 203-H9-5GS-203-H9 | 2429 | EVQLVESGGGLVQPGGSLRLSCTGSGFTFSSYWMDWVRQTPGKDLEYVSG ISPSGGNTDYADSVKGRFTISRDNAKNTLYLQMNSLQPEDTALYYCRRSL TLTDSPDLRSQGTQVTVSSGGGGSEVQLVESGGGLVQPGGSLRLSCTGSG FTFSSYWMDWVRQTPGKDLEYVSGISPSGGNTDYADSVKGRFTISRDNAK NTLYLQMNSLQPEDTALYYCRRSLTLTDSPDLRSQGTQVTVSS |
| 203-H9-25GS-203-H9 | 2430 | EVQLVESGGGLVQPGGSLRLSCTGSGFTFSSYWMDWVRQTPGKDLEYVSG ISPSGGNTDYADSVKGRFTISRDNAKNTLYLQMNSLQPEDTALYYCRRSL TLTDSPDLRSQGTQVTVSSGGGGSGGGGSGGGGSGGGGSGGGGSEVQLVE SGGGLVQPGGSLRLSCTGSGFTFSSYWMDWVRQTPGKDLEYVSGISPSGG NTDYADSVKGRFTISRDNAKNTLYLQMNSLQPEDTALYYCRRSLTLTDSP DLRSQGTQVTVSS |

TABLE A-5

Sequences of multivalent Fc constructs

| Construct | SEQ ID NO | Sequence |
| --- | --- | --- |
| NC41::15GS::NC41::G1-hinge::IgG1-Fc | 2641 | EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGGSGGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK |
| NC41::15GS::NC41::9GS-G1-hinge::IgG1-Fc | 2642 | EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGGSGGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK |
| NC41::15GS::NC41::G3-hinge::IgG1-Fc | 2643 | EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGGSGGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK |
| NC41::G1-hinge::IgG1-Fc::NC41 | 2644 | EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSS |
| NC41::9GS-G1-hinge::IgG1-Fc::NC41 | 2645 | EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSS |
| NC41::G3-hinge::IgG1-Fc::NC41 | 2646 | EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSS |

TABLE A-5-continued

Sequences of multivalent Fc constructs

| Construct | SEQ ID NO | Sequence |
|---|---|---|
| NC41::G1-hinge:: IgG1-Fc::9GS::NC41 | 2647 | EVQLVESGGGLVQAGGSLSISCAASGGSLSNYVLGWFRQAPGKERE FVAAINWRGDITIGPPNVEGRFTISRDNAKNTGYLQMNSLAPDDTA VYYCGAGTPLNPGAYIYDWSYDYWGRGTQVTVSSEPKSCDKTHTCP PCPAPELLGGPSVFLFPPKPKDTLMISRTPEVTCVVVDVSHEDPEV KFNWYVDGVEVHNAKTKPREEQYNSTYRVVSVLTVLHQDWLNGKEY KCKVSNKALPAPIEKTISKAKGQPREPQVYTLPPSRDELTKNQVSL TCLVKGFYPSDIAVEWESNGQPENNYKTTPPVLDSDGSFFLYSKLT VDKSRWQQGNVFSCSVMHEALHNHYTQKSLSLSPGKGGGGSGGGSE VQLVESGGGLVQAGGSLSISCAASGGSLSNYVLGWFRQAPGKEREF VAAINWRGDITIGPPNVEGRFTISRDNAKNTGYLQMNSLAPDDTAV YYCGAGTPLNPGAYIYDWSYDYWGRGTQVTVSS |
| NC41::9GS-G1-hinge ::IgG1-Fc::9GS::NC41 | 2648 | EVQLVESGGGLVQAGGSLSISCAASGGSLSNYVLGWFRQAPGKERE FVAAINWRGDITIGPPNVEGRFTISRDNAKNTGYLQMNSLAPDDTA VYYCGAGTPLNPGAYIYDWSYDYWGRGTQVTVSSGGGGSGGGSEPK SCDKTHTCPPCPAPELLGGPSVFLFPPKPKDTLMISRTPEVTCVVV DVSHEDPEVKFNWYVDGVEVHNAKTKPREEQYNSTYRVVSVLTVLH QDWLNGKEYKCKVSNKALPAPIEKTISKAKGQPREPQVYTLPPSRD ELTKNQVSLTCLVKGFYPSDIAVEWESNGQPENNYKTTPPVLDSDG SFFLYSKLTVDKSRWQQGNVFSCSVMHEALHNHYTQKSLSLSPGKG GGGSGGGSEVQLVESGGGLVQAGGSLSISCAASGGSLSNYVLGWFR QAPGKEREFVAAINWRGDITIGPPNVEGRFTISRDNAKNTGYLQMN SLAPDDTAVYYCGAGTPLNPGAYIYDWSYDYWGRGTQVTVSS |
| NC41::G3-hinge:: IgG1-Fc::9GS::NC41 | 2649 | EVQLVESGGGLVQAGGSLSISCAASGGSLSNYVLGWFRQAPGKERE FVAAINWRGDITIGPPNVEGRFTISRDNAKNTGYLQMNSLAPDDTA VYYCGAGTPLNPGAYIYDWSYDYWGRGTQVTVSSELKTPLGDTTHT CPRCPEPKSCDTPPPCPRCPEPKSCDTPPPCPRCPEPKSCDTPPPC PRCPAPELLGGPSVFLFPPKPKDTLMISRTPEVTCVVVDVSHEDPE VKFNWYVDGVEVHNAKTKPREEQYNSTYRVVSVLTVLHQDWLNGKE YKCKVSNKALPAPIEKTISKAKGQPREPQVYTLPPSRDELTKNQVS LTCLVKGFYPSDIAVEWESNGQPENNYKTTPPVLDSDGSFFLYSKL TVDKSRWQQGNVFSCSVMHEALHNHYTQKSLSLSPGKGGGGSGGGS EVQLVESGGGLVQAGGSLSISCAASGGSLSNYVLGWFRQAPGKERE FVAAINWRGDITIGPPNVEGRFTISRDNAKNTGYLQMNSLAPDDTA VYYCGAGTPLNPGAYIYDWSYDYWGRGTQVTVSS |
| NC41::G1-hinge:: IgG1-Fc::15B3 | 2650 | EVQLVESGGGLVQAGGSLSISCAASGGSLSNYVLGWFRQAPGKERE FVAAINWRGDITIGPPNVEGRFTISRDNAKNTGYLQMNSLAPDDTA VYYCGAGTPLNPGAYIYDWSYDYWGRGTQVTVSSEPKSCDKTHTCP PCPAPELLGGPSVFLFPPKPKDTLMISRTPEVTCVVVDVSHEDPEV KFNWYVDGVEVHNAKTKPREEQYNSTYRVVSVLTVLHQDWLNGKEY KCKVSNKALPAPIEKTISKAKGQPREPQVYTLPPSRDELTKNQVSL TCLVKGFYPSDIAVEWESNGQPENNYKTTPPVLDSDGSFFLYSKLT VDKSRWQQGNVFSCSVMHEALHNHYTQKSLSLSPGKEVQLVESGGG LVQPGGSLRLSCAASGLTLDYYALGWFRQAPGKEREGVSCISSSDH STTYTDSVKGRFTISWDNAKNTLYLQMNSLKPGDTAVYYCAADPAL GCYSGSYYPRYDYWGQGTQVTVSS |
| NC41::9GS-G1-hinge ::IgG1-Fc::15B3 | 2651 | EVQLVESGGGLVQAGGSLSISCAASGGSLSNYVLGWFRQAPGKERE FVAAINWRGDITIGPPNVEGRFTISRDNAKNTGYLQMNSLAPDDT AVYYCGAGTPLNPGAYIYDWSYDYWGRGTQVTVSSGGGGSGGGSE PKSCDKTHTCPPCPAPELLGGPSVFLFPPKPKDTLMISRTPEVTC VVVDVSHEDPEVKFNWYVDGVEVHNAKTKPREEQYNSTYRVVSVL TVLHQDWLNGKEYKCKVSNKALPAPIEKTISKAKGQPREPQVYTL PPSRDELTKNQVSLTCLVKGFYPSDIAVEWESNGQPENNYKTTPP VLDSDGSFFLYSKLTVDKSRWQQGNVFSCSVMHEALHNHYTQKSL SLSPGKEVQLVESGGGLVQPGGSLRLSCAASGLTLDYYALGWFRQ APGKEREGVSCISSSDHSTTYTDSVKGRFTISWDNAKNTLYLQMN SLKPGDTAVYYCAADPALGCYSGSYYPRYDYWGQGTQVTVSS |
| NC41::G3-hinge:: IgG1-Fc::15B3 | 2652 | EVQLVESGGGLVQAGGSLSISCAASGGSLSNYVLGWFRQAPGKER EFVAAINWRGDITIGPPNVEGRFTISRDNAKNTGYLQMNSLAPDD TAVYYCGAGTPLNPGAYIYDWSYDYWGRGTQVTVSSELKTPLGDT THTCPRCPEPKSCDTPPPCPRCPEPKSCDTPPPCPRCPEPKSCDT PPPCPRCPAPELLGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALPAPIEKTISKAKGQPREPQVYTLPPSRDE LTKNQVSLTCLVKGFYPSDIAVEWESNGQPENNYKTTPPVLDSDG SFFLYSKLTVDKSRWQQGNVFSCSVMHEALHNHYTQKSLSLSPGK EVQLVESGGGLVQPGGSLRLSCAASGLTLDYYALGWFRQAPGKER EGVSCISSSDHSTTYTDSVKGRFTISWDNAKNTLYLQMNSLKPGD TAVYYCAADPALGCYSGSYYPRYDYWGQGTQVTVSS |

TABLE A-5-continued

Sequences of multivalent Fc constructs

| Construct | SEQ ID NO | Sequence |
|---|---|---|
| NC41::G1-hinge:: IgG1-Fc::9GS::15B3 | 2653 | EVQLVESGGGLVQAGGSLSISCAASGGSLSNYVLGWFRQAPGKER EFVAAINWRGDITIGPPNVEGRFTISRDNAKNTGYLQMNSLAPDD TAVYYCGAGTPLNPGAYIYDWSYDYWGRGTQVTVSSEPKSCDKTH TCPPCPAPELLGGPSVFLFPPKPKDTLMISRTPEVTCVVVDVSHE DPEVKFNWYVDGVEVHNAKTKPREEQYNSTYRVVSVLTVLHQDWL NGKEYKCKVSNKALPAPIEKTISKAKGQPREPQVYTLPPSRDELT KNQVSLTCLVKGFYPSDIAVEWESNGQPENNYKTTPPVLDSDGSF FLYSKLTVDKSRWQQGNVFSCSVMHEALHNHYTQKSLSLSPGKGG GGSGGGSEVQLVESGGGLVQPGGSLRLSCAASGLTLDYYALGWFR QAPGKEREGVSCISSSDHSTTYTDSVKGRFTISWDNAKNTLYLQM NSLKPGDTAVYYCAADPALGCYSGSYYPRYDYWGQGTQVTVSS |
| NC41::9GS-G1-hinge ::IgG1-Fc::9GS::15B3 | 2654 | EVQLVESGGGLVQAGGSLSISCAASGGSLSNYVLGWFRQAPGKER EFVAAINWRGDITIGPPNVEGRFTISRDNAKNTGYLQMNSLAPDD TAVYYCGAGTPLNPGAYIYDWSYDYWGRGTQVTVSSGGGGSGGGS EPKSCDKTHTCPPCPAPELLGGPSVFLFPPKPKDTLMISRTPEVT CVVVDVSHEDPEVKFNWYVDGVEVHNAKTKPREEQYNSTYRVVSV LTVLHQDWLNGKEYKCKVSNKALPAPIEKTISKAKGQPREPQVYT LPPSRDELTKNQVSLTCLVKGFYPSDIAVEWESNGQPENNYKTTP PVLDSDGSFFLYSKLTVDKSRWQQGNVFSCSVMHEALHNHYTQKS LSLSPGKGGGGSGGGSEVQLVESGGGLVQPGGSLRLSCAASGLTL DYYALGWFRQAPGKEREGVSCISSSDHSTTYTDSVKGRFTISWDN AKNTLYLQMNSLKPGDTAVYYCAADPALGCYSGSYYPRYDYWGQG TQVTVSS |
| NC41::G3-hinge:: IgG1-Fc::9GS::15B3 | 2655 | EVQLVESGGGLVQAGGSLSISCAASGGSLSNYVLGWFRQAPGKER EFVAAINWRGDITIGPPNVEGRFTISRDNAKNTGYLQMNSLAPDD TAVYYCGAGTPLNPGAYIYDWSYDYWGRGTQVTVSSELKTPLGDT THTCPRCPEPKSCDTPPPCPRCPEPKSCDTPPPCPRCPEPKSCDT PPPCPRCPAPELLGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALPAPIEKTISKAKGQPREPQVYTLPPSRDE LTKNQVSLTCLVKGFYPSDIAVEWESNGQPENNYKTTPPVLDSDG SFFLYSKLTVDKSRWQQGNVFSCSVMHEALHNHYTQKSLSLSPGK GGGGSGGGSEVQLVESGGGLVQPGGSLRLSCAASGLTLDYYALGW FRQAPGKEREGVSCISSSDHSTTYTDSVKGRFTISWDNAKNTLYL QMNSLKPGDTAVYYCAADPALGCYSGSYYPRYDYWGQGTQVTVSS |
| NC41::NC41::IgG1-Fc | 2656 | EVQLVESGGGLVQAGGSLSISCAASGGSLSNYVLGWFRQAPGKERE FVAAINWRGDITIGPPNVEGRFTISRDNAKNTGYLQMNSLAPDDTA VYYCGAGTPLNPGAYIYDWSYDYWGRGTQVTVSSGGGGSGGGGSGG GGSEVQLVESGGGLVQAGGSLSISCAASGGSLSNYVLGWFRQAPGK EREFVAAINWRGDITIGPPNVEGRFTISRDNAKNTGYLQMNSLAPD DTAVYYCGAGTPLNPGAYIYDWSYDYWGRGTQVTVSSEPKSCDKTH TCPPCPAPELLGGPSVFLFPPKPKDTLMISRTPEVTCVVVDVSHED PEVKFNWYVDGVEVHNAKTKPREEQYNSTYRVVSVLTVLHQDWLNG KEYKCKVSNKALPAPIEKTISKAKGQPREPQVYTLPPSRDELTKNQ VSLTCLVKGFYPSDIAVEWESNGQPENNYKTTPPVLDSDGSFFLYS KLTVDKSRWQQGNVFSCSVMHEALHNHYTQKSLSLSPGK |
| NC41::IgG1-Fc::NC41 | 2657 | EVQLVESGGGLVQAGGSLSISCAASGGSLSNYVLGWFRQAPGKERE FVAAINWRGDITIGPPNVEGRFTISRDNAKNTGYLQMNSLAPDDTA VYYCGAGTPLNPGAYIYDWSYDYWGRGTQVTVSSEPKSCDKTHTCP PCPAPELLGGPSVFLFPPKPKDTLMISRTPEVTCVVVDVSHEDPEV KFNWYVDGVEVHNAKTKPREEQYNSTYRVVSVLTVLHQDWLNGKEY KCKVSNKALPAPIEKTISKAKGQPREPQVYTLPPSRDELTKNQVSL TCLVKGFYPSDIAVEWESNGQPENNYKTTPPVLDSDGSFFLYSKLT VDKSRWQQGNVFSCSVMHEALHNHYTQKSLSLSPGKEVQLVESGGG LVQAGGSLSISCAASGGSLSNYVLGWFRQAPGKEREFVAAINWRGD ITIGPPNVEGRFTISRDNAKNTGYLQMNSLAPDDTAVYYCGAGTPL NPGAYIYDWSYDYWGRGTQVTVSS |
| NC41::NC41::IgG1-Fc | 2658 | GAAGTACAACTAGTTGAGTCTGGGGGTGGTCTTGTGCAGGCCGGGG GTAGCTTGTCCATTTCATGTGCAGCGAGTGGAGGGAGCCTGTCGAA CTACGTTCTGGGTTGGTTCAGACAAGCTCCTGGGAAGGAAAGAGAA TTTGTCGCTGCAATTAACTGGAGAGGTGATATAACTATTGGCCCTC CAAATGTGGAAGGCCGGTTTACTATTTCCAGGGACAATGCTAAAAA CACGGGTTATCTCCAGATGAACTCCTTGGCTCCGGACGACACTGCC GTGTACTATTGTGGAGCCGGTACCCCCCTCAACCCCGGCGCGTACA TATACGACTGGTCTTACGACTATTGGGGACGGGGCACGCAGGTAAC CGTTAGCAGCGGAGGCGGGGGATCGGGAGGCGGTGGGAGCGGTGGT GGCGGGTCAGAGGTACAACTAGTGGAGAGTGGTGGAGGTCTCGTCC AAGCTGGGGGTTCATTGTCTATTTCGTGTGCTGCCAGCGGAGGATC GCTCAGTAATTACGTGTTAGGCTGGTTTCGCCAAGCACCTGGGAAA GAACGAGAGTTCGTCGCTGCAATCAACTGGCGAGGGGACATAACCA |

TABLE A-5-continued

| Sequences of multivalent Fc constructs | | |
|---|---|---|
| Construct | SEQ ID NO | Sequence |
| | | TAGGTCCACCTAATGTTGAGGGTAGGTTCACAATCTCTCGGGACAA TGCGAAGAACACAGGATATCTTCAGATGAATAGTCTTGCCCCAGAC GATACGGCTGTTTATTATTGCGGTGCAGGGACCCCCCTGAATCCGG GGGCCTACATTTATGATTGGTCATACGATTATTGGGGACGTGGGAC CCAAGTTACTGTGTCTTCGGAACCAAAGTCGTGCGATAAGACCCAT ACCTGTCCGCCCTGTCCTGCTCCGGAACTTCTAGGCGGCCCCTCTG TGTTTCTTTTCCCACCCAAGCCGAAGGATACGCTTATGATTTCTCG CACCCCAGAAGTGACGTGTGTTGTCGTCGACGTTAGTCATGAAGAC CCAGAGGTCAAATTTAATTGGTACGTCGACGGGGTCGAAGTCCACA ATGCGAAAACTAAACCTAGGGAGGAGCAATACAACTCGACATATCG TGTAGTCAGCGTCCTGACTGTCTTACATCAGGACTGGCTCAACGGT AAAGAATATAAATGTAAGGTCTCTAACAAAGCTTTGCCTGCGCCGA TTGAAAAGACCATATCTAAAGCGAAGGGACAACCAAGAGAACCACA AGTGTATACGTTACCGCCGTCACGAGACGAACTGACAAAGAACCAG GTCTCTCTCACCTGCCTGGTCAAGGGGTTTTACCCTAGCGACATTG CCGTCGAGTGGGAATCCAACGGACAGCCCGAAAATAACTACAAGAC AACTCCCCCGGTTTTAGATTCGGACGGGAGTTTTTTTCTGTATAGT AAACTTACGGTTGATAAGTCGCGCTGGCAGCAAGGCAACGTCTTCT CTTGTTCTGTGATGCATGAGGCGCTCCACAATCACTATACCCAAAA ATCGCTCTCCTTGTCGCCAGGCAAATGA |
| NC41::IgG1-Fc::NC41 | 2659 | GAGGTGCAATTGGTAGAGAGTGGCGGAGGTCTAGTGCAAGCGGGAG GCTCGCTGAGCATTAGCTGCGCAGCATCGGGCGGATCGTTGTCTAA CTACGTTCTGGGCTGGTTTAGGCAAGCGCCAGGGAAAGAGAGAGAG TTCGTCGCTGCGATAAACTGGCGCGGTGACATAACGATCGGACCTC CAAATGTAGAAGGAAGATTCACCATTAGCAGAGACAATGCAAAGAA CACGGGTTACCTACAGATGAACTCACTGGCTCCGGACGACACTGCA GTGTACTACTGTGGTGCAGGGACTCCCCTAAACCCAGGGGCATATA TTTATGACTGGTCATACGATTATTGGGGCAGAGGAACGCAAGTGAC CGTCAGCAGTGAACCCAAAAGCTGTGACAAGACCCATACATGCCCT CCCTGTCCAGCGCCCGAACTGCTTGGAGGACCAAGTGTTTTCTTAT TCCCGCCAAAGCCCAAGGACACGTTGATGATTAGCAGGACCCCGGA AGTGACATGCGTAGTTGTAGATGTAAGCCACGAAGATCCGGAGGTC AAGTTCAATTGGTATGTTGATGGGGTGGAAGTGCATAACGCTAAAA CTAAACCACGTGAGGAACAGTACAACTCTACTTACAGGGTAGTGTC GGTATTGACAGTTCTGCATCAAGATTGGCTAAACGGCAAAGAATAT AAGTGTAAAGTAAGTAATAAAGCGCTCCCCGCACCCATTGAAAAGA CCATTTCGAAGGCAAAGGGTCAGCCACGCGAGCCGCAGGTGTATAC ACTGCCCCCTTCCAGGGACGAGCTTACGAAGAACCAGGTTAGCTTG ACTTGCCTTGTAAAGGGATTCTACCCCAGTGACATAGCAGTAGAAT GGGAATCGAACGGGCAACCCGAAAACAATTACAAGACAACCCCACC GGTCTTGGACTCTGATGGCTCTTTCTTCTTGTACTCCAAGTTAACC GTAGACAAATCGAGGTGGCAGCAAGGAAACGTTTTCTCGTGCTCTG TAATGCATGAGGCGTTGCATAACCATTATACTCAGAAGAGCCTGTC ACTGTCGCCGGGTAAAGAAGTGCAGCTTGTGGAATCAGGAGGGGGG CTCGTTCAAGCTGGAGGGAGCCTGTCGATCAGCTGCGCAGCGTCCG GAGGCTCGCTAAGTAACTACGTCCTCGGTTGGTTTAGACAGGCCCC AGGCAAGGAAAGGGAATTTGTTGCGGCAATAAATTGGCGAGGAGAT ATAACCATCGGGCCACCCAATGTAGAAGGAAGGTTCACTATTTCGC GGGATAACGCGAAGAATACGGGCTATCTTCAGATGAATTCATTGGC TCCGGACGACACTGCCGTTTACTATTGCGGTGCAGGGACACCGTTG AACCCAGGCGCGTACATTTACGACTGGTCCTACGATTACTGGGGGC GCGGCACGCAAGTTACCGTGTCCAGCTGA |
| 191D3::15GS::191E4::G1-hinge::IgG1-Fc | 2978 | EVQLVESGGGLVQAGGSLRLSCEASGRTYSRYGMGWFRQAPGKERE FVAAVSRLSGPRTVYADSVKGRFTISRDNAENTVYLQMNSLKPEDT AVYTCAAELTNRNSGAYYYAWAYDYWGQGTQVTVSSGGGGSGGGGS GGGGSEVQLVESGGGLVQAGGSLRLSCAASGPTFSADTMGWFRQAP GKEREFVATIPWSGGIAYYSDSVKGRFTMSRDNAKNTVDLQMNSLK PEDTALYYCAGSSRIYIYSDSLSERSYDYWGQGTQVTVSSEPKSCD KTHTCPPCPAPELLGGPSVFLFPPKPKDTLMISRTPEVTCVVVDVS HEDPEVKFNWYVDGVEVHNAKTKPREEQYNSTYRVVSVLTVLHQDW LNGKEYKCKVSNKALPAPIEKTISKAKGQPREPQVYTLPPSRDELT KNQVSLTCLVKGFYPSDIAVEWESNGQPENNYKTTPPVLDSDGSFF LYSKLTVDKSRWQQGNVFSCSVMHEALHNHYTQKSLSLSPGK |
| 191D3::15GS::191E4::9GS-G1-hinge::IgG1-Fc | 2979 | EVQLVESGGGLVQAGGSLRLSCEASGRTYSRYGMGWFRQAPGKERE FVAAVSRLSGPRTVYADSVKGRFTISRDNAENTVYLQMNSLKPEDT AVYTCAAELTNRNSGAYYYAWAYDYWGQGTQVTVSSGGGGSGGGGS GGGGSEVQLVESGGGLVQAGGSLRLSCAASGPTFSADTMGWFRQAP GKEREFVATIPWSGGIAYYSDSVKGRFTMSRDNAKNTVDLQMNSLK PEDTALYYCAGSSRIYIYSDSLSERSYDYWGQGTQVTVSSGGGGSG GGSEPKSCDKTHTCPPCPAPELLGGPSVFLFPPKPKDTLMISRTPE VTCVVVDVSHEDPEVKFNWYVDGVEVHNAKTKPREEQYNSTYRVVS VLTVLHQDWLNGKEYKCKVSNKALPAPIEKTISKAKGQPREPQVYT |

TABLE A-5-continued

Sequences of multivalent Fc constructs

| Construct | SEQ ID NO | Sequence |
|---|---|---|
| | | LPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 191D3::15GS::191E4::G3-hinge::IgG1-Fc | 2980 | EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGGSGGGGSEVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSSELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 191D3::G1-hinge::IgG1-Fc::191E4 | 2981 | EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKEVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSS |
| 191D3::9GS-G1-hinge::IgG1-Fc::191E4 | 2982 | EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKEVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSS |
| 191D3::G3-hinge::IgG1-Fc::191E4 | 2983 | EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKEVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSS |
| 191D3::G1-hinge::IgG1-Fc::9GS::191E4 | 2984 | EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSEVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSS |
| 191D3::9GS-G1-hinge::IgG1-Fc::9GS::191E4 | 2985 | EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSEVQLVESGGGLVQAGGSLRLSCAASGPTFSADTMGW |

TABLE A-5-continued

| Sequences of multivalent Fc constructs | | |
|---|---|---|
| Construct | SEQ ID NO | Sequence |
| | | FRQAPGKEREFVATIPWSGGIAYYSDSVKGRFTMSRDNAKNTVDLQ MNSLKPEDTALYYCAGSSRIYIYSDSLSERSYDYWGQGTQVTVSS |
| 191D3::G3-hinge:: IgG1-Fc::9GS::191E4 | 2986 | EVQLVESGGGLVQAGGSLRLSCEASGRTYSRYGMGWFRQAPGKERE FVAAVSRLSGPRTVYADSVKGRFTISRDNAENTVYLQMNSLKPEDT AVYTCAAELTNRNSGAYYYAWAYDYWGQGTQVTVSSELKTPLGDTT HTCPRCPEPKSCDTPPPCPRCPEPKSCDTPPPCPRCPEPKSCDTPP PCPRCPAPELLGGPSVFLFPPKPKDTLMISRTPEVTCVVVDVSHED PEVKFNWYVDGVEVHNAKTKPREEQYNSTYRVVSVLTVLHQDWLNG KEYKCKVSNKALPAPIEKTISKAKGQPREPQVYTLPPSRDELTKNQ VSLTCLVKGFYPSDIAVEWESNGQPENNYKTTPPVLDSDGSFFLYS KLTVDKSRWQQGNVFSCSVMHEALHNHYTQKSLSLSPGKGGGGSGG GSEVQLVESGGGLVQAGGSLRLSCAASGPTFSADTMGWFRQAPGKE REFVATIPWSGGIAYYSDSVKGRFTMSRDNAKNTVDLQMNSLKPED TALYYCAGSSRIYIYSDSLSERSYDYWGQGTQVTVSS |
| 191D3::191E4::IgG1-Fc | 2987 | EVQLVESGGGLVQAGGSLRLSCEASGRTYSRYGMGWFRQAPGKERE FVAAVSRLSGPRTVYADSVKGRFTISRDNAENTVYLQMNSLKPEDT AVYTCAAELTNRNSGAYYYAWAYDYWGQGTQVTVSSGGGGSGGGGS GGGGSEVQLVESGGGLVQAGGSLRLSCAASGPTFSADTMGWFRQAP GKEREFVATIPWSGGIAYYSDSVKGRFTMSRDNAKNTVDLQMNSLK PEDTALYYCAGSSRIYIYSDSLSERSYDYWGQGTQVTVSSEPKSCD KTHTCPPCPAPELLGGPSVFLFPPKPKDTLMISRTPEVTCVVVDVS HEDPEVKFNWYVDGVEVHNAKTKPREEQYNSTYRVVSVLTVLHQDW LNGKEYKCKVSNKALPAPIEKTISKAKGQPREPQVYTLPPSRDELT KNQVSLTCLVKGFYPSDIAVEWESNGQPENNYKTTPPVLDSDGSFF LYSKLTVDKSRWQQGNVFSCSVMHEALHNHYTQKSLSLSPGK |
| 191D3::IgG1-Fc::191E4 | 2988 | EVQLVESGGGLVQAGGSLRLSCEASGRTYSRYGMGWFRQAPGKERE FVAAVSRLSGPRTVYADSVKGRFTISRDNAENTVYLQMNSLKPEDT AVYTCAAELTNRNSGAYYYAWAYDYWGQGTQVTVSSEPKSCDKTHT CPPCPAPELLGGPSVFLFPPKPKDTLMISRTPEVTCVVVDVSHEDP EVKFNWYVDGVEVHNAKTKPREEQYNSTYRVVSVLTVLHQDWLNGK EYKCKVSNKALPAPIEKTISKAKGQPREPQVYTLPPSRDELTKNQV SLTCLVKGFYPSDIAVEWESNGQPENNYKTTPPVLDSDGSFFLYSK LTVDKSRWQQGNVFSCSVMHEALHNHYTQKSLSLSPGKEVQLVESG GGLVQAGGSLRLSCAASGPTFSADTMGWFRQAPGKEREFVATIPWS GGIAYYSDSVKGRFTMSRDNAKNTVDLQMNSLKPEDTALYYCAGSS RIYIYSDSLSERSYDYWGQGTQVTVSS |

TABLE A-6

| Amino acid sequence of multivalent Nanobody constructs that bind rabies virus | | |
|---|---|---|
| Construct | SEQ ID NO: | Sequence |
| 213H7-15GS-213H7 | 2427 | EVQLVESGGGLVQAGGSLRLSCAASGRTLSSYRMGWFRQAPGKEREFISTIS WNGRSTYYADSVKGRFIFSEDNAKNTVYLQMNSLKPEDTAVYYCAAALIGGY YSDVDAWSYWGPGTQVTVSSGGGGSGGGGSGGGGSEVQLVESGGGLVQAGGS LRLSCAASGRTLSSYRMGWFRQAPGKEREFISTISWNGRSTYYADSVKGRFI FSEDNAKNTVYLQMNSLKPEDTAVYYCAAALIGGYYSDVDAWSYWGPGTQVT VSS |
| 214E8-15GS-214-E8 | 2663 | EVQLVESGGGSVQAGGSLRLSCAASGGTFNPYVMAWFRQAPGNEREFVARIR WSGGDAYYDDSVKGRFAITRDAAKNTVHLQMNSLKPEDTAVYYCAAATYGYG SYTYGGSYDLWGQGTQVTVSSGGGGSGGGGSGGGGSEVQLVESGGGSVQAGG SLRLSCAASGGTFNPYVMAWFRQAPGNEREFVARIRWSGGDAYYDDSVKGRF AITRDAAKNTVHLQMNSLKPEDTAVYYCAAATYGYGSYTYGGSYDLWGQGTQ VTVSS |
| 212C12-15GS-212C12 | 2664 | EVQLVESGGGLVQPGGSLRLSCAASGFTFGSSDMSWVRQAPGKGPEWVSGIN SGGGRTLYADSVKGRFTISRDNAKNTLYLQMNSLKSEDTAVYYCATDLYGSS WYTDYWSQGTQVTVSSGGGGSGGGGSGGGGSEVQLVESGGGLVQPGGSLRLS CAASGFTFGSSDMSWVRQAPGKGPEWVSGINSGGGRTLYADSVKGRFTISRD NAKNTLYLQMNSLKSEDTAVYYCATDLYGSSWYTDYWSQGTQVTVSS |
| 213E6-5GS-213E6 | 2665 | EVQLVESGGGLVQAGASLRLSCAASGSTLSRYGVGWFRQAPGKERELVASVD WSGSRTYYADSVKGRFTISRDNAKNTGYLQMNSLKPDDTAVYYCAADSSVVP GIEKYDDWGLGTQVTVSSGGGGSEVQLVESGGGLVQAGASLRLSCAASGSTL |

TABLE A-6-continued

Amino acid sequence of multivalent Nanobody constructs that bind rabies virus

| Construct | SEQ ID NO: | Sequence |
|---|---|---|
| | | SRYGVGWFRQAPGKERELVASVDWSGSRTYYADSVKGRFTISRDNAKNTGYLQMNSLKPDDTAVYYCAADSSVVPGIEKYDDWGLGTQVTVSS |
| 213E6-25GS-213E6 | 2666 | EVQLVESGGGLVQAGASLRLSCAASGSTLSRYGVGWFRQAPGKERELVASVDWSGSRTYYADSVKGRFTISRDNAKNTGYLQMNSLKPDDTAVYYCAADSSVVPGIEKYDDWGLGTQVTVSSGGGGSGGGGSGGGGSGGGGSGGGGSEVQLVESGGGLVQAGASLRLSCAASGSTLSRYGVGWFRQAPGKERELVASVDWSGSRTYYADSVKGRFTISRDNAKNTGYLQMNSLKPDDTAVYYCAADSSVVPGIEKYDDWGLGTQVTVSS |
| 214F8-15GS-214F8 | 2667 | EVQLVESGGDLVQAGGSLRLSCVASGSTYSINAMGWYRQAPGKLRELVAAFRTGGSTDYADSVKGRFTISRDTAKNTVYLQMNSLKPEDTAVYYCNAEVIYYPYDYWGQGTQVTVSSGGGGSGGGGSGGGGSEVQLVESGGDLVQAGGSLRLSCVASGSTYSINAMGWYRQAPGKLRELVAAFRTGGSTDYADSVKGRFTISRDTAKNTVYLQMNSLKPEDTAVYYCNAEVIYYPYDYWGQGTQVTVSS |
| 213E6-5GS-212C12 | 2668 | EVQLVESGGGLVQAGASLRLSCAASGSTLSRYGVGWFRQAPGKERELVASVDWSGSRTYYADSVKGRFTISRDNAKNTGYLQMNSLKPDDTAVYYCAADSSVVPGIEKYDDWGLGTQVTVSSGGGGSEVQLVESGGGLVQPGGSLRLSCAASGFTFGSSDMSWVRQAPGKGPEWVSGINSGGGRTLYADSVKGRFTISRDNAKNTLYLQMNSLKSEDTAVYYCATDLYGSSWYTDYWSQGTQVTVSS |
| 213E6-25GS-212C12 | 2669 | EVQLVESGGGLVQAGASLRLSCAASGSTLSRYGVGWFRQAPGKERELVASVDWSGSRTYYADSVKGRFTISRDNAKNTGYLQMNSLKPDDTAVYYCAADSSVVPGIEKYDDWGLGTQVTVSSGGGGSGGGGSGGGGSGGGGSGGGGSEVQLVESGGGLVQPGGSLRLSCAASGFTFGSSDMSWVRQAPGKGPEWVSGINSGGGRTLYADSVKGRFTISRDNAKNTLYLQMNSLKSEDTAVYYCATDLYGSSWYTDYWSQGTQVTVSS |
| 213E6-25GS-214E8 | 2670 | EVQLVESGGGLVQAGASLRLSCAASGSTLSRYGVGWFRQAPGKERELVASVDWSGSRTYYADSVKGRFTISRDNAKNTGYLQMNSLKPDDTAVYYCAADSSVVPGIEKYDDWGLGTQVTVSSGGGGSGGGGSGGGGSGGGGSGGGGSEVQLVESGGGSVQAGGSLRLSCAASGGTFNPYVMAWFRQAPGNEREFVARIRWSGGDAYYDDSVKGRFAITRDAAKNTVHLQMNSLKPEDTAVYYCAAATYGYGSYTYGGSYDLWGQGTQVTVSS |
| 213E6-15GS-213H7 | 2671 | EVQLVESGGGLVQAGASLRLSCAASGSTLSRYGVGWFRQAPGKERELVASVDWSGSRTYYADSVKGRFTISRDNAKNTGYLQMNSLKPDDTAVYYCAADSSVVPGIEKYDDWGLGTQVTVSSGGGGSGGGGSGGGGSEVQLVESGGGLVQAGGSLRLSCAASGRTLSSYRMGWFRQAPGKEREFISTISWNGRSTYYADSVKGRFIFSEDNAKNTVYLQMNSLKPEDTAVYYCAAALIGGYYSDVDAWSYWGPGTQVTVSS |
| 214E8-5GS-212C12 | 2672 | EVQLVESGGGSVQAGGSLRLSCAASGGTFNPYVMAWFRQAPGNEREFVARIRWSGGDAYYDDSVKGRFAITRDAAKNTVHLQMNSLKPEDTAVYYCAAATYGYGSYTYGGSYDLWGQGTQVTVSSGGGGSEVQLVESGGGLVQPGGSLRLSCAASGFTFGSSDMSWVRQAPGKGPEWVSGINSGGGRTLYADSVKGRFTISRDNAKNTLYLQMNSLKSEDTAVYYCATDLYGSSWYTDYWSQGTQVTVSS |
| 214E8-15GS-212C12 | 2673 | EVQLVESGGGSVQAGGSLRLSCAASGGTFNPYVMAWFRQAPGNEREFVARIRWSGGDAYYDDSVKGRFAITRDAAKNTVHLQMNSLKPEDTAVYYCAAATYGYGSYTYGGSYDLWGQGTQVTVSSGGGGSGGGGSGGGGSEVQLVESGGGLVQPGGSLRLSCAASGFTFGSSDMSWVRQAPGKGPEWVSGINSGGGRTLYADSVKGRFTISRDNAKNTLYLQMNSLKSEDTAVYYCATDLYGSSWYTDYWSQGTQVTVSS |
| 214E8-25GS-212C12 | 2674 | EVQLVESGGGSVQAGGSLRLSCAASGGTFNPYVMAWFRQAPGNEREFVARIRWSGGDAYYDDSVKGRFAITRDAAKNTVHLQMNSLKPEDTAVYYCAAATYGYGSYTYGGSYDLWGQGTQVTVSSGGGGSGGGGSGGGGSGGGGSGGGGSEVQLVESGGGLVQPGGSLRLSCAASGFTFGSSDMSWVRQAPGKGPEWVSGINSGGGRTLYADSVKGRFTISRDNAKNTLYLQMNSLKSEDTAVYYCATDLYGSSWYTDYWSQGTQVTVSS |
| 214E8-15GS-213H7 | 2675 | EVQLVESGGGSVQAGGSLRLSCAASGGTFNPYVMAWFRQAPGNEREFVARIRWSGGDAYYDDSVKGRFAITRDAAKNTVHLQMNSLKPEDTAVYYCAAATYGYGSYTYGGSYDLWGQGTQVTVSSGGGGSGGGGSGGGGSEVQLVESGGGLVQAGGSLRLSCAASGRTLSSYRMGWFRQAPGKEREFISTISWNGRSTYYADSVKGRFIFSEDNAKNTVYLQMNSLKPEDTAVYYCAAALIGGYYSDVDAWSYWGPGTQVTVSS |
| 213H7-15GS-214F8 | 2676 | EVQLVESGGGLVQAGGSLRLSCAASGRTLSSYRMGWFRQAPGKEREFISTISWNGRSTYYADSVKGRFIFSEDNAKNTVYLQMNSLKPEDTAVYYCAAALIGGYYSDVDAWSYWGPGTQVTVSSGGGGSGGGGSGGGGSEVQLVESGGDLVQAGGSLRLSCVASGSTYSINAMGWYRQAPGKLRELVAAFRTGGSTDYADSVKGRFTISRDTAKNTVYLQMNSLKPEDTAVYYCNAEVIYYPYDYWGQGTQVTVSS |

TABLE A-6-continued

| Amino acid sequence of multivalent Nanobody constructs that bind rabies virus | | |
|---|---|---|
| Construct | SEQ ID NO: | Sequence |
| 213E6-15GS-214E8 | 2677 | EVQLVESGGGLVQAGASLRLSCAASGSTLSRYGVGWFRQAPGKERELVASVDWSGSRTYYADSVKGRFTISRDNAKNTGYLQMNSLKPDDTAVYYCAADSSVVPGIEKYDDWGLGTQVTVSSGGGGSGGGGSGGGGSEVQLVESGGGSVQAGGSLRLSCAASGGTFNPYVMAWFRQAPGNEREFVARIRWSGGDAYYDDSVKGRFAITRDAAKNTVHLQMNSLKPEDTAVYYCAAATYGYGSYTYGGSYDLWGQGTQVTVSS |
| 214E8-15GS-213E6 | 2678 | EVQLVESGGGSVQAGGSLRLSCAASGGTFNPYVMAWFRQAPGNEREFVARIRWSGGDAYYDDSVKGRFAITRDAAKNTVHLQMNSLKPEDTAVYYCAAATYGYGSYTYGGSYDLWGQGTQVTVSSGGGGSGGGGSGGGGSEVQLVESGGGLVQAGASLRLSCAASGSTLSRYGVGWFRQAPGKERELVASVDWSGSRTYYADSVKGRFTISRDNAKNTGYLQMNSLKPDDTAVYYCAADSSVVPGIEKYDDWGLGTQVTVSS |
| 214F8-15GS-213H7 | 2679 | EVQLVESGGDLVQAGGSLRLSCVASGSTYSINAMGWYRQAPGKLRELVAAFRTGGSTDYADSVKGRFTISRDTAKNTVYLQMNSLKPEDTAVYYCNAEVIYYPYDYWGQGTQVTVSSGGGGSGGGGSGGGGSEVQLVESGGGLVQAGGSLRLSCAASGRTLSSYRMGWFRQAPGKEREFISTISWNGRSTYYADSVKGRFIFSEDNAKNTVYLQMNSLKPEDTAVYYCAAALIGGYYSDVDAWSYWGPGTQVTVSS |
| 214E8-5GS-214E8 | 2680 | EVQLVESGGGSVQAGGSLRLSCAASGGTFNPYVMAWFRQAPGNEREFVARIRWSGGDAYYDDSVKGRFAITRDAAKNTVHLQMNSLKPEDTAVYYCAAATYGYGSYTYGGSYDLWGQGTQVTVSSGGGGSEVQLVESGGGSVQAGGSLRLSCAASGGTFNPYVMAWFRQAPGNEREFVARIRWSGGDAYYDDSVKGRFAITRDAAKNTVHLQMNSLKPEDTAVYYCAAATYGYGSYTYGGSYDLWGQGTQVTVSS |
| 212C12-5GS-212C12 | 2681 | EVQLVESGGGLVQPGGSLRLSCAASGFTFGSSDMSWVRQAPGKGPEWVSGINSGGGRTLYADSVKGRFTISRDNAKNTLYLQMNSLKSEDTAVYYCATDLYGSSWYTDYWSQGTQVTVSSGGGGSEVQLVESGGGLVQPGGSLRLSCAASGFTFGSSDMSWVRQAPGKGPEWVSGINSGGGRTLYADSVKGRFTISRDNAKNTLYLQMNSLKSEDTAVYYCATDLYGSSWYTDYWSQGTQVTVSS |

TABLE A-7

| Linker sequences | | |
|---|---|---|
| Linker | SEQ ID NO: | Sequences |
| 5GS | 2970 | GGGGS |
| 7GS | 2971 | SGGSGGS |
| 9GS | 2639 | GGGGSGGGS |
| 10GS | 2972 | GGGGSGGGGS |
| 15GS | 2662 | GGGGSGGGGSGGGGS |
| 18GS | 2973 | GGGGSGGGGSGGGGGGGS |
| 20GS | 2974 | GGGGSGGGGSGGGGSGGGGS |

TABLE A-7-continued

| Linker sequences | | |
|---|---|---|
| Linker | SEQ ID NO: | Sequences |
| 25GS | 2975 | GGGGSGGGGSGGGGSGGGGSGGGGS |
| 30GS | 2976 | GGGGSGGGGSGGGGSGGGGSGGGGSGGGGS |
| 35GS | 2977 | GGGGSGGGGSGGGGSGGGGSGGGGSGGGGSGGGGS |
| G1 hinge | 2660 | EPKSCDKTHTCPPCP |
| 9GS-G1 hinge | 2661 | GGGGSGGGSEPKSCDKTHTCPPCP |
| G3 hinge | 2640 | ELKTPLGDTTHTCPRCPEPKSCDTPPPCPRCPEPKSCDTPPPCPRCPEPKSCDTPPPCPRCP |

TABLE A-8

| Sequences of humanized NC41 variants | | |
|---|---|---|
| Nanobody | SEQ ID NO: | Sequence |
| NC41 | 5 | EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSS |
| NC41v01 | 2999 | EVQLLESGGGLVQPGGSLRLSCAASGGSLSNYVLGWFRQAPGKGREFVAAINWRGDITIGPPNVEGRFTISRDNAKNTLYLQMNSLAPEDTAVYYCGAGTPLNPGAYIYDWSYDYWGQGTLVTVSS |

TABLE A-8-continued

Sequences of humanized NC41 variants

| Nanobody | SEQ ID NO: | Sequence |
|---|---|---|
| NC41v02 | 3000 | EVQLLESGGGLVQPGGSLRISCAASGGSLSNYVLGWFRQAPGKGREFVA AINWRGDITIGPPNVEGRFTISRDNSKNTLYLQMNSLAPEDTAVYYCGA GTPLNPGAYIYDWSYDYWGQGTLVTVSS |
| NC41v03 | 3001 | EVQLLESGGGLVQPGGSLRISCAASGGSLSNYVLGWFRQAPGKGREFVA AINWRGDITIGPPNVEGRFTISRDNSKNTLYLQMNSLRPEDTAVYYCGA GTPLNPGAYIYDWSYDYWGQGTLVTVSS |
| NC41v04 | 3002 | EVQLLESGGGLVQPGGSLSISCAASGGSLSNYVLGWFRQAPGKGREFVA AINWRGDITIGPPNVEGRFTISRDNSKNTLYLQMNSLRPDDTAVYYCGA GTPLNPGAYIYDWSYDYWGQGTLVTVSS |
| NC41v05 | 3003 | EVQLLESGGGLVQPGGSLSISCAASGGSLSNYVLGWFRQAPGKGREFVA AINWRGDITIGPPNVEGRFTISRDNSKNTLYLQMNSLAPEDTAVYYCGA GTPLNPGAYIYDWSYDYWGQGTLVTVSS |
| NC41v06 | 3004 | EVQLLESGGGLVQPGGSLRLSCAASGGSLSNYVLGWFRQAPGKGREFVA AINWRDDITIGPPNVEGRFTISRDNAKNTLYLQMNSLRPEDTAVYYCGA GTPLNPGAYIYDWSYDYWGQGTLVTVSS |
| NC41v07 | 3005 | EVQLLESGGGLVQPGGSLSISCAASGGSLSNYVLGWFRQAPGKGREFVA AINWRGDITIGPPNVEGRFTISRDNAKNTLYLQMNSLAPDDTAVYYCGA GTPLNPGAYIYDWSYDYWGQGTLVTVSS |
| NC41v08 | 3006 | EVQLLESGGGLVQPGGSLSISCAASGGSLSNYVLGWFRQAPGKGREFVA AINWRGDITIGPPNVEGRFTISRDNAKNTLYLQMNSLRPEDTAVYYCGA GTPLNPGAYIYDWSYDYWGQGTLVTVSS |
| NC41v09 | 3007 | EVQLLESGGGLVQPGGSLSISCAASGGSLSNYVLGWFRQAPGKGREFVA AINWRGDITIGPPNVEGRFTISRDNSKNTLYLQMNSLRPDDTAVYYCGA GTPLNPGAYIYDWSYDYWGQGTLVTVSS |
| NC41v10 | 3008 | EVQLLESGGGLVQPGGSLSISCAASGGSLSNYVLGWFRQAPGKGREFVA AINWRGDITIGPPNVEGRFTISRDNAKNTGYLQMNSLAPDDTAVYYCGA GTPLNPGAYIYDWSYDYWGQGTLVTVSS |
| NC41v11 | 3009 | EVQLLESGGGLVQAGGSLSISCAASGGSLSNYVLGWFRQAPGKGREFVA AINWRGDITIGPPNVEGRFTISRDNAKNTGYLQMNSLAPDDTAVYYCGA GTPLNPGAYIYDWSYDYWGQGTLVTVSS |
| NC41v12 | 3010 | EVQLLESGGGLVQPGGSLSISCAASGGSLSNYVLGWFRQAPGKEREFVA AINWRGDITIGPPNVEGRFTISRDNAKNTGYLQMNSLAPDDTAVYYCGA GTPLNPGAYIYDWSYDYWGQGTLVTVSS |
| NC41v13 | 3011 | EVQLLESGGGLVQPGGSLRLSCAASGGSLSNYVLGWFRQAPGKGREFVA AINWRGDITIGPPNVEGRFTISRDNAKNTGYLQMNSLAPEDTAVYYCGA GTPLNPGAYIYDWSYDYWGQGTLVTVSS |
| NC41v14 | 3012 | EVQLLESGGGLVQPGGSLRLSCAASGGSLSNYVLGWFRQAPGKGREFVA AINWRGDITIGPPNVEGRFTISRDNSKNTLYLQMNSLAPEDTAVYYCGA GTPLNPGAYIYDWSYDYWGQGTLVTVSS |
| NC41v15 | 3013 | EVQLLESGGGLVQAGGSLRLSCAASGGSLSNYVLGWFRQAPGKGREFVA AINWRGDITIGPPNVEGRFTISRDNAKNTLYLQMNSLAPEDTAVYYCGA GTPLNPGAYIYDWSYDYWGQGTLVTVSS |
| NC41v17 | 3014 | EVQLLESGGGLVQPGGSLRLSCAASGGSLSNYVLGWFRQAPGKGREFVA AINWRGDITIGPPNVEGRFTISRDNSKNTLYLQMNSLRPEDTAVYYCGA GTPLNPGAYIYDWSYDYWGQGTLVTVSS |
| NC41v18 | 3015 | EVQLLESGGGLVQPGGSLRLSCAASGGSLSNYVLGWFRQAPGKGREFVA AINWRDDITIGPPNVEGRFTISRDNSKNTLYLQMNSLRPEDTAVYYCGA GTPLNPGAYIYDWSYDYWGQGTLVTVSS |

TABLE A-9

| Amino acid sequence of multivalent humanized constructs that bind hRSV | | |
|---|---|---|
| Nanobody | SEQ ID NO: | Sequence |
| RSV414 | 2996 | EVQLLESGGGLVQPGGSLRISCAASGGSLSNYVLGWFRQAPGKGREFVAAINWRGDITIGPPNVEGRFTISRDNSKNTLYLQMNSLRPEDTAVYYCGAGTPLNPGAYIYDWSYDYWGQGTLVTVSSGGGGSGGGGSGGGGSEVQLLESGGGLVQPGGSLRISCAASGGSLSNYVLGWFRQAPGKGREFVAAINWRGDITIGPPNVEGRFTISRDNSKNTLYLQMNSLRPEDTAVYYCGAGTPLNPGAYIYDWSYDYWGQGTLVTVSSGGGGSGGGGSGGGGSEVQLLESGGGLVQPGGSLRISCAASGGSLSNYVLGWFRQAPGKGREFVAAINWRGDITIGPPNVEGRFTISRDNSKNTLYLQMNSLRPEDTAVYYCGAGTPLNPGAYIYDWSYDYWGQGTLVTVSS |
| RSV426 | 2997 | EVQLLESGGGLVQPGGSLRLSCAASGGSLSNYVLGWFRQAPGKGREFVAAINWRDDITIGPPNVEGRFTISRDNAKNTLYLQMNSLRPEDTAVYYCGAGTPLNPGAYIYDWSYDYWGQGTLVTVSSGGGGSGGGGSGGGGSEVQLLESGGGLVQPGGSLRLSCAASGGSLSNYVLGWFRQAPGKGREFVAAINWRDDITIGPPNVEGRFTISRDNAKNTLYLQMNSLRPEDTAVYYCGAGTPLNPGAYIYDWSYDYWGQGTLVTVSSGGGGSGGGGSGGGGSEVQLLESGGGLVQPGGSLRLSCAASGGSLSNYVLGWFRQAPGKGREFVAAINWRDDITIGPPNVEGRFTISRDNAKNTLYLQMNSLRPEDTAVYYCGAGTPLNPGAYIYDWSYDYWGQGTLVTVSS |
| RSV427 | 2998 | EVQLLESGGGLVQPGGSLRLSCAASGGSLSNYVLGWFRQAPGKGREFVAAINWRDDITIGPPNVEGRFTISRDNSKNTLYLQMNSLRPEDTAVYYCGAGTPLNPGAYIYDWSYDYWGQGTLVTVSSGGGGSGGGGSGGGGSEVQLLESGGGLVQPGGSLRLSCAASGGSLSNYVLGWFRQAPGKGREFVAAINWRDDITIGPPNVEGRFTISRDNSKNTLYLQMNSLRPEDTAVYYCGAGTPLNPGAYIYDWSYDYWGQGTLVTVSSGGGGSGGGGSGGGGSEVQLLESGGGLVQPGGSLRLSCAASGGSLSNYVLGWFRQAPGKGREFVAAINWRDDITIGPPNVEGRFTISRDNSKNTLYLQMNSLRPEDTAVYYCGAGTPLNPGAYIYDWSYDYWGQGTLVTVSS |

TABLE A-10

| Amino acid sequence of multivalent constructs that bind hRSV | | |
|---|---|---|
| Construct | SEQ ID NO | Sequence |
| RSV101 | 3016 | EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGGSGGGGSEVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSS |
| RSV102 | 3017 | EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGGSGGGGSGGGGSGGGGSEVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSS |
| RSV103 | 3018 | EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGGSGGGGSGGGGSGGGGSGGGGSGGGGSEVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSS |
| RSV104 | 3019 | EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGSEVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSS |
| RSV105 | 3020 | EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSS |
| RSV106 | 3021 | EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSS |

TABLE A-10-continued

Amino acid sequence of multivalent constructs that bind hRSV

| Construct | SEQ ID NO | Sequence |
|---|---|---|
| RSV107 | 3022 | EVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSSGGGGSGGGSEVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSS |
| RSV108 | 3023 | EVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSSGGGGSGGGGSGGGGSEVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSS |
| RSV109 | 3024 | EVQLVESGGGLVQPGGSLRLSCAASGRTFSSIAMGWFRQAPGKEREFVAAISWSRGRTFYADSVKGRFIISRDDAANTAYLQMNSLKPEDTAVYYCAVDTASWNSGSFIYDWAYDHWGQGTQVTVSSGGGGSGGGSEVQLVESGGGLVQPGGSLRLSCAASGRTFSSIAMGWFRQAPGKEREFVAAISWSRGRTFYADSVKGRFIISRDDAANTAYLQMNSLKPEDTAVYYCAVDTASWNSGSFIYDWAYDHWGQGTQVTVSS |
| RSV110 | 3025 | EVQLVESGGGLVQPGGSLRLSCAASGRTFSSIAMGWFRQAPGKEREFVAAISWSRGRTFYADSVKGRFIISRDDAANTAYLQMNSLKPEDTAVYYCAVDTASWNSGSFIYDWAYDHWGQGTQVTVSSGGGGSGGGGSGGGGSEVQLVESGGGLVQPGGSLRLSCAASGRTFSSIAMGWFRQAPGKEREFVAAISWSRGRTFYADSVKGRFIISRDDAANTAYLQMNSLKPEDTAVYYCAVDTASWNSGSFIYDWAYDHWGQGTQVTVSS |
| RSV113 | 3026 | EVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSSGGGGSGGGGSGGGGSEVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSS |
| RSV114 | 3027 | EVQLVESGGGWVQAGGSLRLSCAASGRAFSSYAMGWIRQAPGKEREFVAGIDQSGESTAYGASASGRFIISRDNAKNTVHLLMNSLQSDDTAVYYCVADGVLATTLNWDYWGQGTQVTVSSGGGGSGGGGSGGGGSGGGGSEVQLVESGGGWVQAGGSLRLSCAASGRAFSSYAMGWIRQAPGKEREFVAGIDQSGESTAYGASASGRFIISRDNAKNTVHLLMNSLQSDDTAVYYCVADGVLATTLNWDYWGQGTQVTVSS |
| RSV115 | 3028 | EVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSSGGGGSGGGGSGGGGGGGSEVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSS |
| RSV116 | 3029 | EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGGSGGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSS |
| RSV201 | 3030 | EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGSEVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSS |
| RSV202 | 3031 | EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGGSGGGGSEVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSS |
| RSV203 | 3032 | EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGGSGGGGSGGGGSGGGGSEVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSS |
| RSV204 | 3033 | EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSS |

TABLE A-10-continued

Amino acid sequence of multivalent constructs that bind hRSV

| Construct | SEQ ID NO | Sequence |
|---|---|---|
| RSV205 | 3034 | EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSS |
| RSV206 | 3035 | EVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSS |
| RSV207 | 3036 | EVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSS |
| RSV301 | 3037 | EVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSSGGGGSGGGSEVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSS |
| RSV302 | 3038 | EVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSSGGGGSGGGGSGGGGSEVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSS<br>HHH |
| RSV303 | 3039 | EVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSSGGGGSGGGGSGGGGSGGGGSGGGGSEVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSS |
| RSV305 | 3040 | EVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSS |
| RSV306 | 3041 | EVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSSGGGGSGGGGSGGGGSEVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSS |
| RSV400 | 3042 | EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSS |
| RSV401 | 3043 | EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSS |
| RSV402 | 3044 | EVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQAGDSLRLSCAASGRTFSSYAMGWFRQAPGKEREFVAAISWSDGSTYYADSVK |

TABLE A-10-continued

Amino acid sequence of multivalent constructs that bind hRSV

| Construct | SEQ ID NO | Sequence |
|---|---|---|
| | | GRFTISRDNAKNTVYLQMNSLKPEDTAVYYCAADLTSTNPGSYIYIWAYDYWGQGTQV TVSS |
| RSV403 | 3045 | EVQLVESGGGLVQAGDSLRLSCAASGRTFSSYAMGWFRQAPGKEREFVAAISWSDGST YYADSVKGRFTISRDNAKNTVYLQMNSLKPEDTAVYYCAADLTSTNPGSYIYIWAYDY WGQGTQVTVSSGGGGSGGGGSGGGGSEVQLVESGGGLVQPGGSLRLSCAASGLTLDYY ALGWFRQAPGKEREGVSCISSSDHSTTYTDSVKGRFTISWDNAKNTLYLQMNSLKPGD TAVYYCAADPALGCYSGSYYPRYDYWGQGTQVTVSSGGGGSGGGGSGGGGSEVQLVES GGGLVQAGDSLRLSCAASGRTFSSYAMGWFRQAPGKEREFVAAISWSDGSTYYADSVK GRFTISRDNAKNTVYLQMNSLKPEDTAVYYCAADLTSTNPGSYIYIWAYDYWGQGTQV TVSS |
| RSV404 | 3046 | EVQLVESGGGLVQAGGSLRLSCAASGRSFSNYVLGWFRQAPGKEREFVAAISFRGDSA IGAPSVEGRFTISRDNAKNTGYLQMNSLVPDDTAVYYCGAGTPLNPGAYIYDWSYDYW GRGTQVTVSSGGGGSGGGGSGGGGSEVQLVESGGGLVQAGGSLRLSCAASGRSFSNYV LGWFRQAPGKEREFVAAISFRGDSAIGAPSVEGRFTISRDNAKNTGYLQMNSLVPDDT AVYYCGAGTPLNPGAYIYDWSYDYWGRGTQVTVSSGGGGSGGGGSGGGGSEVQLVESG GGLVQAGGSLRLSCAASGRSFSNYVLGWFRQAPGKEREFVAAISFRGDSAIGAPSVEG RFTISRDNAKNTGYLQMNSLVPDDTAVYYCGAGTPLNPGAYIYDWSYDYWGRGTQVTV SS |
| RSV405 | 3047 | EVQLVESGGGLVQAGGSLRLSCEASGRTYSRYGMGWFRQAPGKEREFVAAVSRLSGPR TVYADSVKGRFTISRDNAENTVYLQMNSLKPEDTAVYTCAAELTNRNSGAYYYAWAYD YWGQGTQVTVSSGGGGSGGGGSGGGGSEVQLVESGGGLVQAGGSLRLSCEASGRTYSR YGMGWFRQAPGKEREFVAAVSRLSGPRTVYADSVKGRFTISRDNAENTVYLQMNSLKP EDTAVYTCAAELTNRNSGAYYYAWAYDYWGQGTQVTVSSGGGGSGGGGSGGGGSEVQL VESGGGLVQAGGSLRLSCEASGRTYSRYGMGWFRQAPGKEREFVAAVSRLSGPRTVYA DSVKGRFTISRDNAENTVYLQMNSLKPEDTAVYTCAAELTNRNSGAYYYAWAYDYWGQ GTQVTVSS |
| RSV406 | 3048 | EVQLVESGGGLVQPGGSLRLSCAASGRTFSSIAMGWFRQAPGKEREFVAAISWSRGRT FYADSVKGRFIISRDDAANTAYLQMNSLKPEDTAVYYCAVDTASWNSGSFIYDWAYDH WGQGTQVTVSSGGGGSGGGGSGGGGSEVQLVESGGGLVQPGGSLRLSCAASGRTFSSI AMGWFRQAPGKEREFVAAISWSRGRTFYADSVKGRFIISRDDAANTAYLQMNSLKPED TAVYYCAVDTASWNSGSFIYDWAYDHWGQGTQVTVSSGGGGSGGGGSGGGGSEVQLVE SGGGLVQPGGSLRLSCAASGRTFSSIAMGWFRQAPGKEREFVAAISWSRGRTFYADSV KGRFIISRDDAANTAYLQMNSLKPEDTAVYYCAVDTASWNSGSFIYDWAYDHWGQGTQ VTVSS |
| RSV407 | 3049 | EVQLVESGGGLVQAGGSLSISCAASGGSLSNYVLGWFRQAPGKEREFVAAINWRGDIT IGPPNVEGRFTISRDNAKNTGYLQMNSLAPDDTAVYYCGAGTPLNPGAYIYDWSYDYW GRGTQVTVSSGGGGSGGGGSGGGGSEVQLVESGGGLVQAGGSLSISCAASGGSLSNYV LGWFRQAPGKEREFVAAINWRGDITIGPPNVEGRFTISRDNAKNTGYLQMNSLAPDDT AVYYCGAGTPLNPGAYIYDWSYDYWGRGTQVTVSSGGGGSGGGGSGGGGSEVQLVESG GGLVQAGGSLSISCAASGGSLSNYVLGWFRQAPGKEREFVAAINWRGDITIGPPNVEG RFTISRDNAKNTGYLQMNSLAPDDTAVYYCGAGTPLNPGAYIYDWSYDYWGRGTQVTV SS |
| RSV408 | 3050 | EVQLVESGGGLVQAGGSLSISCAASGGSLSNYVLGWFRQAPGKEREFVAAINWRGDIT IGPPNVEGRFTISRDNAKNTGYLQMNSLAPDDTAVYYCGAGTPLNPGAYIYDWSYDYW GRGTQVTVSSAAAEVQLVESGGGLVQAGGSLSISCAASGGSLSNYVLGWFRQAPGKER EFVAAINWRGDITIGPPNVEGRFTISRDNAKNTGYLQMNSLAPDDTAVYYCGAGTPLN PGAYIYDWSYDYWGRGTQVTVSSAAAEVQLVESGGGLVQAGGSLSISCAASGGSLSNY VLGWFRQAPGKEREFVAAINWRGDITIGPPNVEGRFTISRDNAKNTGYLQMNSLAPDD TAVYYCGAGTPLNPGAYIYDWSYDYWGRGTQVTVSS |
| RSV409 | 3051 | EVQLVESGGGLVQAGGSLSISCAASGGSLSNYVLGWFRQAPGKEREFVAAINWRGDIT IGPPNVEGRFTISRDNAKNTGYLQMNSLAPDDTAVYYCGAGTPLNPGAYIYDWSYDYW GRGTQVTVSSGGGGSGGGSEVQLVESGGGLVQAGGSLSISCAASGGSLSNYVLGWFRQ APGKEREFVAAINWRGDITIGPPNVEGRFTISRDNAKNTGYLQMNSLAPDDTAVYYCG AGTPLNPGAYIYDWSYDYWGRGTQVTVSSGGGGSGGGSEVQLVESGGGLVQAGGSLSI SCAASGGSLSNYVLGWFRQAPGKEREFVAAINWRGDITIGPPNVEGRFTISRDNAKNT GYLQMNSLAPDDTAVYYCGAGTPLNPGAYIYDWSYDYWGRGTQVTVSS |
| RSV410 | 3052 | EVQLVESGGGLVQAGGSLSISCAASGGSLSNYVLGWFRQAPGKEREFVAAINWRGDIT IGPPNVEGRFTISRDNAKNTGYLQMNSLAPDDTAVYYCGAGTPLNPGAYIYDWSYDYW GRGTQVTVSSGGGGSGGGGSGGGGSGGGGSEVQLVESGGGLVQAGGSLSISCAASGGS LSNYVLGWFRQAPGKEREFVAAINWRGDITIGPPNVEGRFTISRDNAKNTGYLQMNSL APDDTAVYYCGAGTPLNPGAYIYDWSYDYWGRGTQVTVSSGGGGSGGGGSGGGGSGGG GSEVQLVESGGGLVQAGGSLSISCAASGGSLSNYVLGWFRQAPGKEREFVAAINWRGD ITIGPPNVEGRFTISRDNAKNTGYLQMNSLAPDDTAVYYCGAGTPLNPGAYIYDWSYD YWGRGTQVTVSS |

TABLE A-10-continued

| Construct | SEQ ID NO | Sequence |
|---|---|---|
| RSV411 | 3053 | EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGGSGGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGGSGGGGSEVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSS |
| RSV412 | 3054 | EVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSSGGGGSGGGGSGGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGGSGGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSS |
| RSV413 | 3055 | EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGGSGGGGSEVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSSGGGGSGGGGSGGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSS |
| RSV502 | 3056 | EVQLVESGGGLVQAGGSLRLSCEASGRTFSSYGMGWFRQAPGKEREFVAAVSRLSGPRTVYADSVKGRFTISRDNAENTVYLQMNSLKPEDTAVYTCAAELTNRNPGAYYYTWAYDYWGQGTQVTVSSGGGGSGGGGSGGGGSEVQLVESGGGLVQAGGSLRLSCEASGRTFSSYGMGWFRQAPGKEREFVAAVSRLSGPRTVYADSVKGRFTISRDNAENTVYLQMNSLKPEDTAVYTCAAELTNRNPGAYYYTWAYDYWGQGTQVTVSSGGGGSGGGGSGGGGSEVQLVESGGGLVQAGGSLRLSCEASGRTFSSYGMGWFRQAPGKEREFVAAVSRLSGPRTVYADSVKGRFTISRDNAENTVYLQMNSLKPEDTAVYTCAAELTNRNPGAYYYTWAYDYWGQGTQVTVSS |
| RSV513 | 3588 | EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQPGGSLRLSCAASGLTLDYYALGWFRQAPGKEREGVSCISSSDHTTTYTDSVKGRFTISWDNAKNTLYLQMNSLKPEDTAVYYCAADPALGCYSGSYYPRYDFWGQGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSS |
| RSV514 | 3589 | EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGSEVQLVESGGGLVQPGGSLRLSCAASGLTLDYYALGWFRQAPGKEREGVSCISSSDHTTTYTDSVKGRFTISWDNAKNTLYLQMNSLKPEDTAVYYCAADPALGCYSGSYYPRYDFWGQGTQVTVSSGGGGSGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSS |
| RSV515 | 3590 | EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQPGGSLRVSCAASGFTFNDYIMGWFRQAPGKERMFIAAISGTGTIKYYGDLVRGRFTISRDNAKNTVYLRIDSLNPEDTAVYYCAARQDYGLGYRESHEYDYWGQGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSS |
| RSV516 | 3591 | EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGSEVQLVESGGGLVQPGGSLRVSCAASGFTFNDYIMGWFRQAPGKERMFIAAISGTGTIKYYGDLVRGRFTISRDNAKNTVYLRIDSLNPEDTAVYYCAARQDYGLGYRESHEYDYWGQGTQVTVSSGGGGSGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSS |

Amino acid sequence of multivalent constructs that bind hRSV

TABLE C-1

Overview of the RFFIT tests on periplasmic fractions of the NANOBODIES ® ($V_{HH}$ sequences) of the invention as described in Example 14.

| Sample | | Rabies neutralizing antibody titer (50% dilution) | Remark |
|---|---|---|---|
| Polyclonal anti-hRSV periplasmic fractions | Lama C | <0.5 IU/ml (<1/9) | no neutralisation |
| Polyclonal anti-rabies vaccine virus periplasmic fractions | Lama 1 210 | <0.5 IU/ml (<1/9) | no neutralisation |
| Polyclonal anti-rabies glycoprotein G periplasmic fractions | Lama 2 211 | 3.18 IU/ml (1/88) | strong neutralisation |
| Monoclonal anti-hRSV periplasmic fractions | 192-D3 | <0.5 IU/ml (<1/9) | no neutralisation |
| | 192-B6 | <0.5 IU/ml (<1/9) | no neutralisation |
| | 192-C4 | <0.5 IU/ml (<1/9) | no neutralisation |
| Monoclonal anti-H5N1 periplasmic fractions | 202-C1 | <0.5 IU/ml (<1/9) | no neutralisation |
| | 202-F4 | <0.5 IU/ml (<1/9) | no neutralisation |
| | 202-B7 | <0.5 IU/ml (<1/9) | no neutralisation |
| Anti-rabies glycoprotein G periplasmic fractions, total elution | 213-D6 | <0.5 IU/ml (<1/9) | no neutralisation |
| | 213-E6 | 5.31 (1/140) | strong neutralisation |
| | 213-B7 | 0.62 (1/16) | neutralisation |
| | 213-D7 | 0.62 (1/16) | neutralisation |
| | 213-H7 | 0.83 (1/22) | neutralisation |
| Anti-rabies glycoprotein G periplasmic fractions, monoclonal antibody eluted | 214-A8 | 1.42 (1/38) | neutralisation |
| | 214-E8 | <0.5 IU/ml (1/11) | 0.42 = minor neutralisation, but below cut-off |
| | 214-F8 | 0.65 (1/17) | neutralisation |
| | 214-C10 | <0.5 IU/ml (<1/9) | 0.25 = minor neutralisation, but below cut-off |
| | 214-D10 | <0.5 IU/ml (<1/9) | 0.25 = minor neutralisation, but below cut-off |
| | 214-H10 | 0.67 (1/18) | neutralisation |
| Anti-"other viral coat protein" control periplasmic fractions | 202-D4 | <0.5 IU/ml (<1/9) | no neutralisation |
| | 202-F7 | <0.5 IU/ml (<1/9) | no neutralisation |
| | 192-D2 | <0.5 IU/ml (<1/9) | no neutralisation |
| | 192-F4 | <0.5 IU/ml (<1/9) | no neutralisation |

TABLE C-2

Binding of selected NANOBODIES ® ($V_{HH}$ sequences) to immobilized $F_{TM-}$ protein in Surface Plasmon Resonance.

| name | clone | ka (1/Ms) | kd (1/s) | KD (M) |
|---|---|---|---|---|
| NB1 | 192-C4 | 1.13E+06 | 8.46E−03 | 7.47E−09 |
| NB2 | 191-D3 | 1.59E+06 | 3.24E−03 | 2.05E−09 |
| NB4 | 192-H1 | 1.65E+06 | 6.11E−03 | 3.72E−09 |
| NB5 | 192-A8 | 3.22E+05 | 9.37E−04 | 2.91E−09 |
| NB6 | 191-E4 | 2.98E+05 | 2.08E−04 | 7.00E−10 |
| NB9 | 192-C6 | 1.15E+06 | 8.08E−03 | 7.00E−09 |
| NB10 | 192-F2 | 8.07E+05 | 5.77E−03 | 7.14E−09 |
| NB11 | 191-B9 | 1.94E+05 | 4.92E−03 | 2.54E−03 |
| NB13 | 192-H2 | 8.29E+05 | 1.28E−02 | 1.54E−08 |
| NB14 | 192-B1 | 2.29E+05 | 1.27E−02 | 5.55E−08 |
| NB15 | 192-C10 | 1.75E+05 | 6.13E−04 | 3.49E−09 |

TABLE C-3

Classification of viral fusion proteins based on the structural motifs of their post-fusion conformations

| Virus family | Virus species | Protein database code |
|---|---|---|
| Class I | | |
| Orthomyxo-viridae | Influenza A virus HA<br>Influenza C virus HEF | 1HA0, 3HMG, 1HTM, 1QU1, 1FLC |

TABLE C-3-continued

Classification of viral fusion proteins based on the structural motifs of their post-fusion conformations

| Virus family | Virus species | Protein database code |
|---|---|---|
| Paramyxo-viridae | Simian parainfluenza virus 5 F | 2B9B, 1SVF |
| | Human parainfluenza virus F | 1ZTM |
| | Newcastle disease virus F | 1G5G |
| | Respiratory syncytial F | 1G2C |
| | Measles F2 | |
| | Sendai F2 | |
| Filoviridae | Ebola virus gp2 | 1EBO, 2EBO |
| Retroviridae | Moloney murine leukemia virus TM | 1AOL |
| | Human immunodeficiency virus 1 gp41 | 1ENV, 1AIK |
| | Simian immunodeficiency virus gp41 | 2SIV, 2EZO |
| | Human T cell leukemia virus 1 gp21 | 1MG1 |
| | Human syncytin-2 TM | 1Y4M |
| | Visna virus TM | 1JEK |
| Coronaviridae | Mouse hepatitis virus S2 | 1WDG |
| | SARS corona virus E2 | 2BEQ, 1WYY |
| Class II | | |
| Flaviviridae | Tick-borne encephalitis virus E | 1URZ, 1SVB |
| | Dengue 2 and 3 virus E2 | 1OK8 IUZG, |
| | Yellow Fever E | 10AN, 1TG8 |
| | West Nile E | |
| Togaviridae | Semliki forest virus E1 | 1E9W, 1RER |
| | Sindbis E1 | |
| Class III | | |
| Rhabdoviridae | Rabies virus G | 2GUM |
| | Vesicular stomatitis virus G | |
| Herpesviridae | Herpes simplex virus gB | 2CMZ |

TABLE C-4

Sequence analysis of hRSV Nanobodies from new libraries

| 206 | | | | | | 207 | | | 212 | | | | 212 | |
|---|---|---|---|---|---|---|---|---|---|---|---|---|---|---|
| clone | family | epitope | clone | family | epitope | clone | family | epitope | clone | family | epitope | clone | family | epitope |
| 5C1 | 1 n = 4 | IV-VI | 5A1 | 4sub4 n = 13 | IV-VI | 8C8 | 2 | IV-VI | 5A8 | 7 | binder | 7B9 | 18 | IV-VI |
| 8A1 | | | 5G2 | | | 5A6 | 3 n = 9 | IV-VI | 5A10 | 8 n = 4 | binder | 7E7 | 20 | binder |
| 8G1 | | | 5H1 | | | 8E11 | | | 14A6 | | | | | |
| 25B3 | | | 6B1 | | | 8F11 | | | 16A6 | | | | | |
| 5A2 | | | 8H2 | | | 13F11 | | | 22D6 | | | | | |
| 5B2 | | | 8H3 | | | 15B8 | | | 7G1 | 15 | binder | | | |
| 5C3 | | | 13A3 | | | 15G11 | | | 5A9 | 16 n = 5 | II | | | |
| 5D2 | | | 13C5 | | | 17C10 | | | 7B2 | | | | | |
| 5E2 | | | 13H1 | | | 21E7 | | | 22A4 | | | | | |
| 5F3 | | | 13H2 | | | 21F8 | | | 22E10 | | | | | |
| 5G3 | | | 15E6 | | | 5G4 | 6 n = 5 | IV-VI | 22H4 | | | | | |
| 5H2 | | | 17A3 | | | 6G5 | | | 14H3 | 21 | IV-VI | | | |
| 5H3 | | | 25G8 | | | 8E6 | | | 24D6 | 22 | IV-VI | | | |
| 8C1 | | | 6D1 | 5 n = 12 | IV-VI | 13A10 | | | 23E5 | 23 | IV-VI | | | |
| 8F2 | | | 8D5 | | | 21H10 | | | 14E2 | 25 | IV-VI | | | |
| 8G4 | | | 13B4 | | | 5C6 | 11 n = 6 | IV-VI | 23G1 | 28 | binder | | | |
| 13A1 | | | 13B6 | | | 6D4 | | | | | | | | |
| 13A4 | | | 13E6 | | | 8B10 | | | | | | | | |
| 13B1 | | | 13F4 | | | 8E10 | | | | | | | | |

| | | | | | | | | |
|---|---|---|---|---|---|---|---|---|
| 13B2 | 4sub1 n = 36 | IV-VI | 15H3 | | | 15A7 | | |
| 13C1 | | | 17E5 | | | 15E10 | | |
| 13C3 | | | 19D3 | | | 13C7 | 12 | IV-VI |
| 13D6 | | | 19F3 | | | 15A9 | | |
| 13E2 | | | 25C4 | | | 15F11 | | |
| 13E3 | | | 25E3 | | | 17A9 | 14 | IV-VI |
| 15A5 | | | 8E2 | 9 | IV-VI | 15E11 | 19 | IV-VI |
| 15A6 | | | 8C6 | 10 | IV-VI | 19A6 | 27 | IV-VI |
| 15B2 | | | 15A1 | 13 | II | 15H8 | 29 | II |
| 15B3 | | | 6H2 | | | NC41 | | |
| 15E5 | | | 15C5 | 17 | IV-VI | 6AB | 30 | IV-VI |
| 17C2 | | | NC39 | | | 8B11 | 32 | IV-VI |
| 17D4 | | | 8A6 | 24 | IV-VI | | | |
| 17G4 | | | 25F3 | 26 | II | | | |
| 19B2 | | | 25H9 | 31 | IV-VI | | | |
| 25A4 | | | 17E1 | 33 n = 4 | II | | | |
| 25A9 | | | 21A4 | | | | | |
| 25B5 | | | 25A11 | | | | | |
| 25G2 | | | 25C8 | | | | | |
| 25H5 | | | NC23 | 34 | II | | | |
| 25E11 | | | | | | | | |

| | | |
|---|---|---|
| 8G3 | 4sub2 n = 5 | |
| 13B5 | | |
| 15F2 | | |
| 19E2 | | |
| 25D1 | | |

TABLE C-5

Characteristics of Nanobodies that bind hRSV F-protein

| Clone | Family | Epitope | Binding hRSV EC50 | Competition Synagis ® Fab EC50 | kinetic analysis ka (1/Ms) | kd(1/s) | KD | RSV neutralization IC50 (nM)(n = 2) Long | A-2 | B1 |
|---|---|---|---|---|---|---|---|---|---|---|
| 191D3 | LG 3sub2 | II | 1.5E−10 | 5.9E−09 | 1.5E+06 | 2.8E−03 | 1.9E−09 | 253 | 227 | — |
| 1E4 | LG 3sub2 | II | 6.6E−11 | 4.5E−09 | 8.0E+05 | 1.3E−03 | 1.6E−09 | 380 | 298 | ND |
| 7B2 | 16 | II | 9.0E−11 | 1.9E−09 | 5.7E+05 | 6.5E−04 | 1.1E−09 | 91 | 177 | 2690 |
| NC23 | 34 | II | 1.0E−10 | 2.3E−09 | 8.0E+05 | 7.4E−04 | 9.2E−10 | 144 | 109 | — |
| 15H8 | 29 | II | 8.3E−10 | 3.9E−08 | 1.2E+06 | 2.1E−02 | 1.6E−08 | 200 | 218 | 2340 |
| NC41 | 29 | II | 4.1E−10 | 3.2E−08 | 8.2E+05 | 6.7E−03 | 8.1E−09 | 58 | 26 | 4000 |
| 15B3 | 4sub1 | IV-VI | 5.8E−11 | — | 4.1E+05 | 2.7E−04 | 6.7E−10 | — | — | 1274 |
| 191E4 | LG 21 | IV-VI | 8.3E−11 | — | 5.7E+05 | 1.5E−04 | 2.7E−10 | — | — | 4327 |
| Synagis ® | | II | | | 2.8E+05 | 1.8E−04 | 6.4E−10 | 4 | 2.5 | 1.7 |

TABLE C-6

Nomenclature for multivalent Nanobodies directed against hRSV F-protein

| Type | Name | Construct | SEQ ID NO: |
|---|---|---|---|
| Bivalent | RSV101 | 191D3-15GS-191D3 | 2382 |
| | RSV102 | 191D3-25GS-191D3 | 2383 |
| | RSV103 | 191D3-35GS-191D3 | 2384 |
| | RSV104 | 191D3-9GS-191D3 | 2385 |
| | RSV105 | 7B2-9GS-7B2 | 2386 |
| | RSV106 | 7B2-15GS-7B2 | 2387 |
| | RSV107 | 15H8-9GS-15H8 | 2388 |
| | RSV108 | 15H8-15GS-15H8 | 2389 |
| | RSV109 | NC23-9GS-NC23 | 2390 |
| | RSV110 | NC23-15GS-NC23 | 2391 |
| | RSV113 | 15B3-15GS-15B3 | 2392 |
| | RSV114 | NC39-20GS-NC39 | 2393 |
| | RSV115 | 191E4-18GS-191E4 | 2394 |
| | RSV116 | NC41-15GS-NC41 | 2395 |
| Biparatope | RSV201 | 191D3-9GS-191E4 | 2396 |
| | RSV202 | 191D3-15GS-191E4 | 2397 |
| | RSV203 | 191D3-25GS-191E4 | 2398 |
| | RSV204 | 7B2-15GS-15H8 | 2399 |
| | RSV205 | 7B2-15GS-15B3 | 2400 |
| | RSV206 | 15H8-15GS-15B3 | 2401 |
| | RSV207 | 15H8-15GS-7B2 | 2402 |
| | RSV301 | 191E4-9GS-191D3 | 2403 |
| | RSV302 | 191E4-15GS-191D3 | 2404 |
| | RSV303 | 191E4-25GS-191D3 | 2405 |
| | RSV305 | 15B3-15GS-7B2 | 2406 |
| | RSV306 | 15B3-15GS-15H8 | 2407 |
| | RSV513 | 7B2-15GS-19E2-15GS-7B2 | 3584 |
| | RSV514 | 7B2-9GS-19E2-9GS-7B2 | 3585 |
| | RSV515 | 7B2-15GS-8A1-15GS-7B2 | 3586 |
| | RSV516 | 7B2-9GS-8A1-9GS-7B2 | 3587 |
| Trivalent | RSV400 | 7B2-15GS-7B2-15GS-7B2 | 2408 |
| | RSV401 | 7B2-15GS-7B2-15GS-15B3 | 2409 |
| | RSV402 | 15B3-15GS-7B2-15GS-7B2 | 2410 |
| | RSV403 | 7B2-15GS-15B3-15GS-7B2 | 2411 |
| | RSV404 | 15H8-15GS-15H8-15GS-15H8 | 2412 |
| | RSV405 | 191D3-15GS-191D3-15GS-191D3 | 2413 |
| | RSV406 | NC23-15GS-NC23-15GS-NC23 | 2414 |
| | RSV407 | NC41-15GS-NC41-15GS-NC41 | 2415 |
| | RSV408 | NC41-AAA-NC41-AAA-NC41 | 2989 |
| | RSV409 | NC41-9GS-NC41-9GS-NC41 | 2990 |
| | RSV410 | NC41-20GS-NC41-20GS-NC41 | 2991 |
| | RSV411 | NC41-15GS-NC41-15GS-15B3 | 2992 |
| | RSV412 | 15B3-15GS-NC41-15GS-NC41 | 2993 |
| | RSV413 | NC41-15GS-15B3-15GS-NC41 | 2994 |
| | RSV414 | NC41v03-15GS-NC41v03-15GS-NC41v03 | 2996 |

TABLE C-6-continued

Nomenclature for multivalent Nanobodies directed against hRSV F-protein

| Type | Name | Construct | SEQ ID NO: |
|---|---|---|---|
| | RSV426 | NC41v06-15GS-NC41v06-15GS-NC41v06 | 2997 |
| | RSV427 | NC41v18-15GS-NC41v18-15GS-NC41v18 | 2998 |
| | RSV502 | 1E4-15GS-1E4-15GS-1E4 | 2995 |

TABLE C-7

Reactivity of monovalent Nanobodies with antigen extracts of HEp-2 cells infected with different escape mutants of the Long strain

| Nanobody \ Virus | R47F/4 | R47F/7 | RAK13/4 | R7C2/11 | R7C2/1 | R7.936/1 | R7.936/4 | R7.936/6 | R9.432/1 | RRA3 |
|---|---|---|---|---|---|---|---|---|---|---|
| 192C4 | | | | | | | | | | |
| 191D3 | | | | | | | | | | |
| 191E4 | | | | | | | | | | |
| 192F2 | | | | | | | | | | |
| 191C7 | | | | | | | | | | |
| 15B3 | | | | | | | | | | |
| NC23 | | | | | | | | | | |
| 15H8 | | | | | | | | | | |
| 7B2 | | | | | | | | | | |
| NC41 | | | | | | | | | | |
| aa substitution | N262Y | N268I | N216D/N262Y | K272T | K272E | V447A | K433T | K432T | S436F | N262Y/R429S |

TABLE C-8

Reactivity of monovalent and bivalent Nanobodies with antigen extracts of HEp-2 cells infected with different escape mutants of the Long strain

| Nanobody \ Virus | R7C2/11 | R7C2/1 | R7.936/4 |
|---|---|---|---|
| 7B2 | | | |
| RSV106: 7B2-7B2 | | | |
| RSV400: 7B2-7B2-7B2 | | | |
| RSV403: 7B2-15B3-7B2 | | | |
| 15B3 | | | |
| RSV113: 15B3-15B3 | | | |
| 191D3 | | | |
| RSV101: 191D3-191D3 | | | |
| 15H8 | | | |
| RSV108: 15H8-15H8 | | | |
| NC23 | | | |
| RSV110: NC23-NC23 | | | |
| 191E4 | | | |
| aa substitution | K272T | K272E | K433T |

TABLE C-9

Relative viral genomic RNA in lungs of treated mice 3 and 5 days post viral inoculation 3 days post viral inoculation

| relative gRNA level | PBS | LGB1 | LGB2 | Synagis |
|---|---|---|---|---|
| Mouse 1 | 8.64 | 6.31 | 45.80 | 2.13 |
| Mouse 2 | 13.09 | 3.23 | 45.90 | 1.97 |
| Mouse 3 | 43.23 | 2.94 | 8.50 | 4.01 |
| Mouse 4 | 12.10 | 1.01 | 32.99 | 1.63 |
| Mouse 5 | 31.79 | 2.42 | 60.99 | 0.00 |
| Average | 21.77 | 3.18 | 38.84 | 1.95 |
| SD | 13.43 | 1.74 | 17.57 | 1.28 |

TABLE C-9-continued

Relative viral genomic RNA in lungs of treated mice 3 and 5 days post viral inoculation 5 days post viral inoculation

| relative gRNA level | PBS | RSV101 | 12D2biv | Synagis |
|---|---|---|---|---|
| Mouse 1 | 170.69 | 16.96 | 214.74 | 4.82 |
| Mouse 2 | 53.45 | 10.96 | 466.40 | 4.81 |
| Mouse 3 | 471.42 | 3.84 | 350.39 | 7.20 |
| Mouse 4 | 404.66 | 5.60 | 418.76 | 6.32 |
| Mouse 5 | 342.39 | 2.19 | 193.26 | 4.15 |
| Average | 288.52 | 7.91 | 328.71 | 5.46 |
| SD | 172.47 | 6.04 | 121.32 | 1.25 |

TABLE C-10

Viral titers in mouse treated with 202-C8, 191-D3 or only PBS, 4 and 6 days post virus inoculation as described in Example 37

| Group | Mouse 1 | Mouse 2 | Mouse 3 | Geo. Mean | StDev |
|---|---|---|---|---|---|
| Day 4 lung titers (TCID50/ml lung homogenate) | | | | | |
| PBS (n = 3) | 355656 | 63246 | 63246 | 160716 | 137843 |
| 191D3 (n = 3) | 112468 | 112468 | 632456 | 285797 | 245124 |
| 202-C8 (n = 3) | 0 | 0 | 0 | 0 | 0 |
| Day 6 lung titers (TCID50/ml lung homogenate) | | | | | |
| PBS (n = 3) | 63426 | 112468 | 112468 | 96121 | 23119 |
| 191-D3 (n = 3) | 63246 | 112468 | 112468 | 96061 | 23203 |
| 202-C8 (n = 3) | 0 | 0 | 0 | 0 | 0 |

TABLE C-11

Animal weight and viral titers after intranasal administration of Nanobody into mice challenged with virus at different time points after inoculation of the Nanobody (see Example 38)

| | Weight Day 0 | Weight Day 1 | Weight Day 2 | Weight Day 3 | Weight Day 4 | Lung titer Day 4 |
|---|---|---|---|---|---|---|
| 202-C8 4 h mouse 1 | 18,15 | 18,32 | 17,67 | 18,5 | 18,23 | 0 |
| 202-C8 4 h mouse 2 | 20,67 | 20,42 | 20,43 | 20,94 | 20,93 | 0 |
| 202-C8 4 h mouse 3 | 19,72 | 19,67 | 18,97 | 19,68 | 19,77 | 0 |
| Average | 19,51 | 19,47 | 19,02 | 19,71 | 19,64 | 0 |
| St. Dev. | 1.27 | 1.06 | 1.38 | 1.22 | 1.35 | 0 |
| 202-C8 24 h mouse 1 | 18,76 | 18,81 | 18,52 | 18,83 | 18,85 | 0 |
| 202-C8 24 h mouse 2 | 19,48 | 19,62 | 18,99 | 18,96 | 19,13 | 0 |
| 202-C8 24 h mouse 3 | 18,73 | 18,55 | 18,18 | 18,34 | 18,32 | 0 |
| 202-C8 24 h mouse 4 | 19,19 | 19,27 | 18,9 | 19,48 | 19,32 | 0 |
| 202-C8 24 h mouse 5 | 18,95 | 19,24 | 18,36 | 18,96 | 19,06 | 0 |
| 202-C8 24 h mouse 6 | 18,99 | 18,81 | 18,21 | 18,66 | 18,91 | 0 |
| average | 19,02 | 19,05 | 18,53 | 18,87 | 18,93 | 0 |
| St. Dev. | 0.28 | 0.39 | 0.35 | 0.38 | 0.34 | 0 |
| 202-C8 48 h mouse 1 | 17,88 | 17,5 | 17,44 | 17,43 | 17,81 | 9355 |
| 202-C8 48 h mouse 2 | 17,29 | 17,01 | 16,94 | 17,11 | 17,37 | 355656 |
| 202-C8 48 h mouse 3 | 19,42 | 19,08 | 19,2 | 19,33 | 19,44 | 93550 |
| 202-C8 48 h mouse 4 | 19,47 | 19,53 | 18,89 | 19.31 | 19,51 | 0 |
| 202-C8 48 h mouse 5 | 19,73 | 19,55 | 19,34 | 19,54 | 20,02 | 0 |
| 202-C8 48 h mouse 6 | 18,92 | 18,84 | 18,72 | 18,47 | 18,91 | 63250 |
| 202-C8 48 h mouse 7 | 17,94 | 17,65 | 17,82 | 17,74 | 19,49 | 0 |
| average | 18,66 | 18,45 | 18,34 | 18,42 | 18,94 | 74544 |
| St. Dev. | 0.95 | 1.04 | 0.93 | 1.00 | 0.98 | 129378 |
| PBS 4 h mouse 1 | 18,97 | 18,89 | 18,69 | 18,05 | 16,95 | 3556500 |

TABLE C-11-continued

Animal weight and viral titers after intranasal administration of Nanobody into mice challenged with virus at different time points after inoculation of the Nanobody (see Example 38)

| | Weight Day 0 | Weight Day 1 | Weight Day 2 | Weight Day 3 | Weight Day 4 | Lung titer Day 4 |
|---|---|---|---|---|---|---|
| PBS 4 h mouse 2 | 18,15 | 18,36 | 18,13 | 17,32 | 15,95 | 6325000 |
| PBS 4 h mouse 3 | 19,54 | 19,9 | 19,68 | 18,11 | 16,87 | 6325000 |
| Average | 18,89 | 19,05 | 18,83 | 17,83 | 16,59 | 5402167 |
| St. Dev. | 0.70 | 0.78 | 0.78 | 0.44 | 0.56 | 1598394 |
| PBS 48 h mouse 1 | 20,01 | 19,73 | 19,59 | 18,76 | 17,66 | 3556500 |
| PBS 48 h mouse 2 | 21,43 | 21,68 | 20,9 | 20,06 | 19,39 | 632500 |
| PBS 48 h mouse 3 | 18,78 | 19,02 | 18,74 | 17,67 | 16,8 | 632500 |
| average | 20,07 | 20,14 | 19,74 | 18,83 | 17,95 | 1607167 |
| St. Dev. | 1.33 | 1.38 | 1.09 | 1.20 | 1.32 | 1688172 |
| 191-D3 4 h mouse 1 | 20,3 | 20,42 | 20,11 | 19,72 | 19,28 | 6324600 |
| 191-D3 4 h mouse 2 | 18,39 | 18,54 | 18,66 | 18,38 | 18,33 | 9355000 |
| 191-D3 4 h mouse 3 | 18,39 | 18,82 | 18,44 | 17,77 | 16,3 | 3556500 |
| Average | 19,03 | 19,26 | 19,07 | 18,62 | 17,97 | 6412033 |
| St. Dev. | 1.10 | 1.01 | 0.91 | 1.00 | 1.52 | 2900239 |
| 191-D3 24 h mouse 1 | 18,94 | 18,63 | 18,62 | 18,21 | 18,29 | 6324600 |
| 191-D3 24 h mouse 2 | 19,46 | 19,62 | 19,4 | 18,48 | 18,09 | 63250000 |
| 191-D3 24 h mouse 3 | 19,63 | 19,58 | 19,83 | 19,18 | 18,51 | 2000000 |
| 191-D3 24 h mouse 4 | 19,03 | 18,94 | 19,07 | 18,45 | 17,49 | 6325000 |
| 191-D3 24 h mouse 5 | 18,91 | 18,72 | 19 | 17,84 | 17,32 | 935500 |
| average | 19,19 | 19,10 | 19,18 | 18,43 | 17,94 | 15767020 |
| St. Dev. | 0.33 | 0.47 | 0.46 | 0.49 | 0.51 | 26657313 |
| 191-D3 48 h mouse 1 | 19,5 | 19,39 | 18,93 | 19,04 | 18 | 3556500 |
| 191-D3 48 h mouse 2 | 19,53 | 19,3 | 19,2 | 18,76 | 17,94 | 3556500 |
| 191-D3 48 h mouse 3 | 20,02 | 20,23 | 20,46 | 19,81 | 19,26 | 9355000 |
| 191-D3 48 h mouse 4 | 18,21 | 18,09 | 18,12 | 17,75 | 17,29 | 935500 |
| 191-D3 48 h mouse 5 | 18,38 | 18,17 | 18,32 | 17,92 | 16,53 | 6325000 |
| 191-D3 48 h mouse 6 | 21,19 | 20,83 | 20,55 | 20,34 | 18,98 | 632460 |
| average | 19,47 | 19,34 | 19,26 | 18,94 | 18,00 | 4060160 |
| St. Dev. | 1.10 | 1.09 | 1.04 | 1.02 | 1.02 | 3322192 |

TABLE C-12

Test items for use in the study described in Example 42

| Name | Alternative names | Reference |
|---|---|---|
| RSV NB2 | 191D3 | SEQ ID NO: 159 in present application |
| ALX-0081 | 12A2H1-3a-12A2H1 | SEQ ID NO: 98 in WO 06/122825 |
| RANKL008a | | SEQ ID NO: 759 in WO 08/142164 |

TABLE C-13

Study design for study described in Example 42

| Group | Substance | Route | Single Dose (mg/kg) | Number of animals |
|---|---|---|---|---|
| 1 | RSV NB2 | i.v. | 4 | 3 |
| 2 | ALX-0081 | i.v. | 5 | 3 |
| 3 | RANKL008A | i.v. | 5 | 3 |
| 4 | RSV NB2 | i.t. | 3.6 | 28 |
| 5 | ALX-0081 | i.t. | 3.1 | 28 |
| 6 | RANKL008A | i.t. | 3.2 | 28 |
| 7 | — | — | — | 8 |

TABLE C-14

LLOQ and ULOQ for determination of RSV NB2 in rat plasma and BALF samples as described in Example 42

| | LLOQ (ng/ml) | | ULOQ (ng/ml) | |
|---|---|---|---|---|
| PK ELISA | Plate level | Plasma/BALF level | Plate level | Plasma/BALF level |
| RSV NB2 | 0.4 | 4.0 | 20.0 | 200.0 |

TABLE C-15

LLOQ and ULOQ for determination of ALX-0081 in rat plasma and BALF samples as described in Example 42

| | LLOQ (ng/ml) | | ULOQ (ng/ml) | |
|---|---|---|---|---|
| PK ELISA | Plate level | Plasma/BALF | Plate level | Plasma/BALF |
| ALX-0081 | 0.75 | 3.75 | 40.0 | 200.0 |

TABLE C-16

LLOQ and ULOQ for determination of RANKL008A in rat plasma and BALF samples as described in Example 42

| | LLOQ (ng/ml) | | ULOQ (ng/ml) | |
|---|---|---|---|---|
| PK ELISA | Plate level | Plasma/BALF level | Plate level | Plasma/BALF level |
| RANKL008A | 0.1 | 1.0 | 7.5 | 75.0 |

TABLE C-17

Individual plasma concentration-time data of RSV NB2, ALX-0081, and RANKL008A after a single i.v. bolus dose of RSV NB2 (4 mg/kg), ALX-0081 (5 mg/kg) and RANKL008A (5 mg/kg), respectively to male Wistar rats

| Nominal | Plasma concentration after i.v. administration (μg/mL) | | | | | | | | |
|---|---|---|---|---|---|---|---|---|---|
| | RSV NB2 | | | ALX-0081 | | | RANKL008A | | |
| Time | ID 1 | ID 2 | ID 3 | ID 4 | ID 5 | ID 6 | ID 7 | ID 8 | ID 9 |
| 3 min | 23.6 | 34.5 | 32.1 | 60.4 | 63.2 | NS | 94.3 (5 min) | 107 | 100 |
| 15 min | 5.16 | 10.7 | 10.6 | 9.18 | 14.1 | NS | 95.7 | 94.8 | 92.8 |
| 30 min | 3.61 | 5.91 | 3 | 3.15 | 3.37 | 4.55 | 88.4 | 85.9 | 74.1 |
| 1 hr | NS | 5.12 | 2.36 | 1.09 | 1.31 | 1.84 | 81.5 | 73.8 | NS |
| 2 hr | NS | NS | 0.763 | 0.498 | 0.594 | NS | 58.7 | 55.9 | NS |
| 4 hr | NS | NS | 0.161 | 0.219 | 0.315 | 0.328 | 35.8 | 35.1 | NS |
| 6 hr | NS | NS | 0.056 | 0.125 | 0.161 | 0.116 | / | / | / |
| 8 hr | / | / | / | / | / | / | 17.1 | 18.8 | NS |
| 24 hr | BQL | NS | BQL | BQL | BQL | BQL | 3.17 | 3.94 | NS |
| 48 hr | / | / | / | / | / | / | 0.902 | 0.988 | NS |

NS: No sample could be obtained (refer to in vivo report)

BQL: Below Quantification Limit

TABLE C-18

Individual plasma concentration-time data of RSV NB2, ALX-0081, and RANKL008A after a single i.t. dose of RSV NB2 (3.6 mg/kg), ALX-0081 (3.1 mg/kg) and RANKL008A (3.2 mg/kg), respectively to male Wistar rats. 6/8 hr time-point: 6 hr for RSV NB2 and ALX-0081, 8 hr for RANKL008A

| | Plasma concentration after i.t. administration (μg/mL) | | | | | |
|---|---|---|---|---|---|---|
| | RSV NB2 | | ALX-0081 | | RANKL008A | |
| Time | ID | Concentration | ID | Concentration | ID | Concentration |
| 3 min | 10 | 0.158 | 38 | 0.056 | 66 | 0.004 |
| | 11 | 0.085 | 39 | 0.013 | 67 | 0.030 |
| | 12 | 0.081 | 40 | 0.029 | 68 | 0.006 |
| | 13 | 0.127 | 41 | 0.077 | 69 | 0.005 |
| 20 min | 14 | 0.204 | 42 | 0.102 | 70 | 0.072 |
| | 15 | 0.167 | 43 | 0.102 | 71 | 0.081 |
| | 16 | 0.131 | 44 | 0.097 | 72 | 0.151 |
| | 17 | 0.267 | 45 | 0.070 | 73 | 0.083 |
| 1 hr | 18 | 0.202 | 46 | 0.122 | 74 | 0.401 |
| | 19 | 0.167 | 47 | 0.112 | 75 | 0.541 |
| | 20 | 0.120 | 48 | 0.049 | 76 | 0.305 |
| | 21 | 0.120 | 49 | 0.109 | 77 | 1.077 |
| 2 hr | 22 | BQL | 50 | 0.041 | 78 | 0.279 |
| | 23 | 0.230 | 51 | 0.100 | 79 | 0.389 |
| | 24 | 0.091 | 52 | 0.084 | 80 | 0.705 |
| | 25 | 0.202 | 53 | 0.091 | 81 | 0.489 |
| 4 hr | 26 | 0.113 | 54 | 0.069 | 82 | 0.965 |
| | 27 | 0.150 | 55 | 0.077 | 83 | 0.601 |
| | 28 | 0.080 | 56 | 0.053 | 84 | 0.934 |
| | 29 | 0.129 | 57 | 0.085 | 85 | 0.672 |
| 6/8 hr | 30 | 0.125 | 58 | 0.034 | 86 | 0.869 |
| | 31 | 0.071 | 59 | 0.048 | 87 | 1.42 |
| | 32 | 0.108 | 60 | 0.070 | 88 | 1.16 |
| | 33 | 0.091 | 61 | 0.059 | 89 | 0.606 |
| 24 hr | 34 | 0.024 | 62 | 0.014 | 90 | 0.493 |
| | 35 | 0.024 | 63 | 0.022 | 91 | 0.450 |
| | 36 | 0.025 | 64 | 0.014 | 92 | 0.434 |
| | 37 | 0.036 | 65 | 0.020 | 93 | 0.342 |

TABLE C-19

Mean plasma concentration-time data of RSV NB2, ALX-0081, and RANKL008A after a single i.t. dose of RSV NB2 (3.6 mg/kg), ALX-0081 (3.1 mg/kg) and RANKL008A (3.2 mg/kg), respectively to male Wistar rats

| | Plasma concentration after i.t. administration (μg/mL) | | | | | |
|---|---|---|---|---|---|---|
| | RSV NB2 (ID 10-37) | | ALX-0081 (ID 38-65) | | RANKL008A (ID 66-93) | |
| Time | Average | SD | Average | SD | Average | SD |
| 3 min | 0.113 | 0.037 | 0.044 | 0.028 | 0.012 | 0.013 |
| 20 min | 0.192 | 0.058 | 0.093 | 0.015 | 0.097 | 0.037 |
| 1 hr | 0.152 | 0.040 | 0.098 | 0.033 | 0.581 | 0.345 |
| 2 hr | 0.175 | 0.074 | 0.079 | 0.026 | 0.465 | 0.181 |
| 4 hr | 0.118 | 0.030 | 0.071 | 0.014 | 0.793 | 0.184 |
| 6 hr | 0.099 | 0.023 | 0.052 | 0.015 | / | / |
| 8 hr | / | / | / | / | 1.01 | 0.35 |
| 24 hr | 0.027 | 0.006 | 0.018 | 0.004 | 0.430 | 0.063 |

TABLE C-20

Individual Basic Pharmacokinetic parameters of RSV NB2, ALX-0081, and RANKL008A after a single i.v. dose of RSV NB2 (4 mg/kg), ALX-0081 (5 mg/kg) and RANKL008A (5 mg/kg) to Wistar Rats.
i.v.: RSV NB2 4 mg/kg; ALX-0081/RANKL008A 5 mg/kg

| Parameter | Unit | ALX-0081 ID 4 | ALX-0081 ID 5 | RANKL008A ID 7 | RANKL008A ID 8 | RSV NB2 ID 3 |
|---|---|---|---|---|---|---|
| C(0) | ug/mL | 96.7 | 92.0 | 94.3 | 110 | 42.3 |
| Vss | mL/kg | 255 | 250 | 91.5 | 92.8 | 250 |
| CL | mL/hr/kg | 363 | 311 | 9.17 | 8.82 | 363 |
| MRT | hr | 0.702 | 0.804 | 9.98 | 10.5 | 0.690 |
| t½ λz | hr | 2.01 | 2.12 | 13.2 | 12.0 | 0.926 |
| λz Lower | hr | 2 | 2 | 24 | 24 | 0.5 |
| λz Upper | hr | 6 | 6 | 48 | 48 | 6 |
| AUClast | hr * ug/mL | 13.4 | 15.6 | 528 | 550 | 11.0 |
| AUCextrap | % | 2.51 | 3.09 | 3.16 | 3.03 | 0.560 |
| AUCinf | hr * ug/mL | 13.8 | 16.1 | 545 | 567 | 11.0 |
| AUCinf/D | hr * kg/mL | 0.0028 | 0.0032 | 0.1091 | 0.1134 | 0.0028 |

TABLE C-21

Mean Basic Pharmacokinetic parameters of RSV NB2, ALX-0081, and RANKL008A after a single i.v. dose of RSV NB2 (4 mg/kg), ALX-0081 (5 mg/kg) and RANKL008A (5 mg/kg) to Wistar Rats
i.v.: RSV NB2 4 mg/kg; ALX-0081/RANKL008A 5 mg/kg

| | | ALX-0081 | CV | RANKL008A | | |
|---|---|---|---|---|---|---|
| Parameter | Unit | Average | % | Average | CV % | RSV NB2 |
| C(0) | ug/mL | 94.3 | 4 | 102 | 11 | 42.3 |
| Vss | mL/kg | 252 | 1 | 92.1 | 1 | 250 |
| CL | mL/hr/kg | 337 | 11 | 9.00 | 3 | 363 |
| MRT | hr | 0.753 | 10 | 10.2 | 4 | 0.690 |
| t½ λz | hr | 2.06 | 4 | 12.6 | 7 | 0.926 |
| λz Lower | hr | 2 | 0 | 24 | 0 | 0.5 |
| λz Upper | hr | 6 | 0 | 48 | 0 | 6 |
| AUClast | hr * ug/mL | 14.5 | 10 | 539 | 3 | 11.0 |
| AUCextrap | % | 2.80 | 15 | 3.09 | 3 | 0.560 |
| AUCinf | hr * ug/mL | 14.9 | 11 | 556 | 3 | 11.0 |
| AUCinf/D | hr * kg/mL | 0.003 | 9 | 0.111 | 3 | 0.003 |

TABLE C-22

Basic Pharmacokinetic parameters of RSV NB2, ALX-0081, and RANKL008A after a single i.v. dose of RSV NB2 (3.6 mg/kg), ALX-0081 (3.1 mg/kg) and RANKL008A (3.2 mg/kg) to Wistar Rats
i.t. administration

| Parameter | Unit | ALX-0081 3.1 mg/kg | RANKL008A 3.2 mg/kg | RSV NB2 3.6 mg/kg |
|---|---|---|---|---|
| Vss/F | mL/kg | 36339 | 2833 | 21853 |
| CL/F | mL/hr/kg | 2407 | 130 | 1641 |
| MRT | hr | 15.1 | 21.7 | 13.3 |
| t½ λz | hr | 10.5 | 13.0 | 9.48 |
| λz Lower | hr | 2 | 8 | 4 |
| λz Upper | hr | 24 | 24 | 24 |
| t½ λz | | 0.979 | 1.000 | 0.999 |
| AUClast | hr*ug/mL | 1.02 | 16.5 | 1.83 |

TABLE C-22-continued

Basic Pharmacokinetic parameters of RSV NB2, ALX-0081, and RANKL008A after a single i.v. dose of RSV NB2 (3.6 mg/kg), ALX-0081 (3.1 mg/kg) and RANKL008A (3.2 mg/kg) to Wistar Rats
i.t. administration

| Parameter | Unit | ALX-0081 3.1 mg/kg | RANKL008A 3.2 mg/kg | RSV NB2 3.6 mg/kg |
|---|---|---|---|---|
| AUCextrap | % | 20.8 | 32.8 | 16.8 |
| AUCinf | hr*ug/mL | 1.29 | 24.6 | 2.19 |
| tmax | hr | 1 | 8 | 0.330 |
| Cmax | ug/ml | 0.098 | 1.01 | 0.192 |
| AUCinf/D | hr*kg/mL | 0.0004 | 0.0077 | 0.0006 |
| F | % | 13.9 | 6.90 | 22.1 |

Vss/F = MRT*CL (MRT not corrected for MAT)

Estimation F incorrect if CL i.v. and CL i.t. are different; Note dose i.v. ≠ i.t.

TABLE C-23

Individual observed BALF concentrations of RSV NB2, ALX-0081, and RANKL008A after a single intratracheal administration of RSV NB2 (3.6 mg/kg), ALX-0081 (3.1 mg/kg) and RANKL008A (3.2 mg/kg) to male rats

| | BALF concentrations after i.t. administration (μg/mL) | | | | | |
|---|---|---|---|---|---|---|
| | RSV NB2 | | | | | |
| Nominal | | Concen- | ALX-0081 | | RANKL008A | |
| Time | ID | tration | ID | Concentration | ID | Concentration |
| 3 min | 10 | 46.2 | 38 | 145 | 66 | 32.3 |
| | 11 | 65.0 | 39 | 57.9 | 67 | 56.1 |
| | 12 | 23.0 | 40 | 69.2 | 68 | 27.0 |
| | 13 | 36.7 | 41 | 115 | 69 | 80.2 |
| 20 min | 14 | 32.8 | 42 | 40.4 | 70 | 14.4 |
| | 15 | 54.8 | 43 | 148 | 71 | 87.9 |
| | 16 | 70.2 | 44 | 93.4 | 72 | 43.3 |
| | 17 | 68.1 | 45 | 55.7 | 73 | 22.4 |
| 1 hr | 18 | 134 | 46 | 179 | 74 | 124 |
| | 19 | 50.7 | 47 | 80.6 | 75 | 70.3 |
| | 20 | 35.8 | 48 | 62.4 | 76 | 33.8 |
| | 21 | 18.4 | 49 | 35.8 | 77 | 49.8 |
| 2 hr | 22 | BQL | 50 | 33.7 | 78 | 16.1 |
| | 23 | 22.1 | 51 | 36.9 | 79 | 58.3 |
| | 24 | 26.1 | 52 | 111 | 80 | 49.0 |
| | 25 | 32.6 | 53 | 37.1 | 81 | 22.3 |
| 4 hr | 26 | 14.9 | 54 | 32.7 | 82 | 24.8 |
| | 27 | 60.9 | 55 | 2.44 | 83 | 11.4 |
| | 28 | 45.0 | 56 | 85.1 | 84 | 95.0 |
| | 29 | 4.81 | 57 | 50.5 | 85 | 24.9 |
| 6/8 hr | 30 | 24.4 | 58 | 36.2 | 86 | 15.6 |
| | 31 | 43.6 | 59 | 90.1 | 87 | 42.1 |
| | 32 | 21.6 | 60 | 51.9 | 88 | 72.4 |
| | 33 | 33.1 | 61 | 74.6 | 89 | 30.2 |
| 24 hr | 34 | 9.53 | 62 | 20.9 | 90 | 32.7 |
| | 35 | 19.1 | 63 | 13.2 | 91 | 14.6 |
| | 36 | 10.7 | 64 | 16.5 | 92 | 7.48 |
| | 37 | 17.0 | 65 | 14.6 | 93 | 6.91 |

BQL: below the quantification limit

TABLE C-24

Mean observed BALF concentrations of RSV NB2, ALX-0081, and RANKL008A after a single intratracheal administration of RSV NB2 (3.6 mg/kg), ALX-0081 (3.1 mg/kg) and RANKL008A (3.2 mg/kg) to male rats

| | BALF concentration after i.t. administration (μg/mL) | | | | | |
|---|---|---|---|---|---|---|
| | RSV NB2 (ID 10-37) | | ALX-0081 (ID 38-65) | | RANKL008A (ID 66-93) | |
| Nominal Time | Average | SD | Average | SD | Average | SD |
| 3 min | 96.8 | 40.4 | 48.9 | 24.4 | 42.7 | 17.6 |
| 20 min | 84.3 | 47.9 | 35.7 | 32.9 | 56.5 | 17.2 |
| 1 hr | 89.4 | 62.4 | 69.4 | 39.2 | 59.7 | 51.1 |
| 2 hr | 54.6 | 37.5 | 36.4 | 20.4 | 26.9 | 5.3 |
| 4 hr | 42.7 | 34.6 | 39 | 37.9 | 31.4 | 26.1 |
| 6 hr | 63.2 | 23.9 | 40.1 | 24.1 | / | / |
| 8 hr | / | / | / | / | 30.7 | 9.9 |
| 24 hr | 16.3 | 3.4 | 15.4 | 12.1 | 14.1 | 4.7 |

TABLE C-25

Individual theoretical amount (BALF Concentration × 10 mL) of RSV NB2, ALX-0081, and RANKL008A in BALF after single intratracheal administration of RSV NB2 (3.6 mg/kg), ALX-0081 (3.1 mg/kg) and RANKL008A (3.2 mg/kg) to male rats

| | BALF Theoretical Amount after i.t. Administration (μg) | | | | | |
|---|---|---|---|---|---|---|
| | RSV NB2 | | ALX-0081 | | RANKL008A | |
| Nominal Time | ID | Amount | ID | Amount | ID | Amount |
| 4 min | 10 | 462 | 38 | 1446 | 66 | 323 |
| | 11 | 650 | 39 | 579 | 67 | 561 |
| | 12 | 230 | 40 | 692 | 68 | 270 |
| | 13 | 367 | 41 | 1155 | 69 | 802 |
| 20 min | 14 | 328 | 42 | 404 | 70 | 144 |
| | 15 | 548 | 43 | 1479 | 71 | 879 |
| | 16 | 702 | 44 | 934 | 72 | 433 |
| | 17 | 681 | 45 | 557 | 73 | 224 |
| 1 hr | 18 | 1338 | 46 | 1788 | 74 | 1238 |
| | 19 | 507 | 47 | 806 | 75 | 703 |
| | 20 | 358 | 48 | 624 | 76 | 338 |
| | 21 | 184 | 49 | 358 | 77 | 498 |
| 2 hr | 22 | BQL | 50 | 337 | 78 | 161 |
| | 23 | 221 | 51 | 369 | 79 | 583 |
| | 24 | 261 | 52 | 1109 | 80 | 490 |
| | 25 | 326 | 53 | 371 | 81 | 223 |
| 4 hr | 26 | 149 | 54 | 327 | 82 | 248 |
| | 27 | 609 | 55 | 24.4 | 83 | 114 |
| | 28 | 450 | 56 | 851 | 84 | 950 |
| | 29 | 48.1 | 57 | 505 | 85 | 249 |
| 6/8 hr | 30 | 244 | 58 | 362 | 86 | 156 |
| | 31 | 436 | 59 | 901 | 87 | 421 |
| | 32 | 216 | 60 | 519 | 88 | 724 |
| | 33 | 331 | 61 | 746 | 89 | 302 |
| 24 hr | 34 | 95.3 | 62 | 209 | 90 | 327 |
| | 35 | 191 | 63 | 132 | 91 | 146 |
| | 36 | 107 | 64 | 165 | 92 | 74.8 |
| | 37 | 170 | 65 | 146 | 93 | 69.1 |

BQL: below the quantification limit

TABLE C-26

Mean (+SD) theoretical amount (BALF Concentration × 10 mL) of RSV NB2 (3.6 mg/kg), ALX-0081 (3.1 mg/kg) and RANKL008A (3.2 mg/kg) in BALF after intratracheal administration

| | BALF theoretical amount after i.t. administration (μg) | | | | | |
|---|---|---|---|---|---|---|
| | RSV NB2 (ID 10-37) | | ALX-0081 (ID 38-65) | | RANKL008A (ID 66-93) | |
| Nominal Time | Average | SD | Average | SD | Average | SD |
| 4 min | 427 | 176 | 968 | 404 | 489 | 244 |
| 20 min | 565 | 172 | 843 | 479 | 420 | 329 |
| 1 hr | 597 | 511 | 894 | 624 | 694 | 392 |
| 2 hr | 269 | 53 | 546 | 375 | 364 | 204 |
| 4 hr | 314 | 261 | 427 | 346 | 390 | 379 |
| 6 hr | 307 | 99 | 632 | 239 | / | / |
| 8 hr | / | / | / | / | 401 | 241 |
| 24 hr | 141.0 | 47.2 | 163 | 34 | 154 | 121 |

TABLE C-27

Individual recovered volume of BALF after two lavages with DPBS (2 × 5 mL) after a single intratracheal administration of RSV NB2 (3.6 mg/kg), ALX-0081 (3.1 mg/kg) and RANKL008A (3.2 mg/kg) to male rats

| Nominal | Recovered Volume of BALF after lavages | | | | | |
|---|---|---|---|---|---|---|
| | RSV NB2 | | ALX-0081 | | RANKL008A | |
| Time | ID | BALF (mL) | ID | BALF (mL) | ID | BALF (mL) |
| 4 min | 10 | 5.5 | 38 | 7.5 | 66 | 8.0 |
| | 11 | 6.5 | 39 | 6.5 | 67 | 8.0 |
| | 12 | 8.5 | 40 | 8.5 | 68 | 4.0 |
| | 13 | 7.5 | 41 | 7.5 | 69 | 8.5 |
| 20 min | 14 | 8.0 | 42 | 7.0 | 70 | 7.5 |
| | 15 | 6.0 | 43 | 8.0 | 71 | 3.0 |
| | 16 | 6.5 | 44 | 8.0 | 72 | 6.0 |
| | 17 | 8.5 | 45 | 7.5 | 73 | 8.0 |
| 1 hr | 18 | 6.5 | 46 | 8.0 | 74 | 7.0 |
| | 19 | 6.5 | 47 | 7.5 | 75 | 6.0 |
| | 20 | 7.5 | 48 | 8.0 | 76 | 7.5 |
| | 21 | 7.5 | 49 | 7.0 | 77 | 8.0 |
| 2 hr | 22 | 5.5 | 50 | 8.0 | 78 | 6.0 |
| | 23 | 6.0 | 51 | 8.0 | 79 | 7.5 |
| | 24 | 6.5 | 52 | 6.5 | 80 | 8.0 |
| | 25 | 7.0 | 53 | 7.5 | 81 | 8.0 |
| 4 hr | 26 | 5.5 | 54 | 8.0 | 82 | 7.0 |
| | 27 | 5.0 | 55 | 8.0 | 83 | 6.5 |
| | 28 | 9.5 | 56 | 9.0 | 84 | 7.0 |
| | 29 | 8.0 | 57 | 7.5 | 85 | 7.5 |
| 6/8 hr | 30 | 7.0 | 58 | 8.0 | 86 | 7.0 |
| | 31 | 7.0 | 59 | 9.0 | 87 | 6.5 |
| | 32 | 7.0 | 60 | 6.0 | 88 | 7.5 |
| | 33 | 8.5 | 61 | 8.5 | 89 | 9.0 |
| 24 hr | 34 | 6.5 | 62 | 7.5 | 90 | 8.0 |
| | 35 | 6.5 | 63 | 7.5 | 91 | 7.5 |
| | 36 | 7.5 | 64 | 8.5 | 92 | 8.0 |
| | 37 | 7.0 | 65 | 6.5 | 93 | 5.5 |

TABLE C-28

Individual actual amount (BALF Concentration × recovered volume) of RSV NB2, ALX-0081, and RANKL008A in BALF after a single intratracheal administration of RSV NB2 (3.6 mg/kg), ALX-0081 (3.1 mg/kg) and RANKL008A (3.2 mg/kg) to male rats

| Nominal | BALF Actual Amount after i.t. Administration (μg) | | | | | |
|---|---|---|---|---|---|---|
| | RSV NB2 | | ALX-0081 | | RANKL008A | |
| Time | ID | Amount | ID | Amount | ID | Amount |
| 4 min | 10 | 254 | 38 | 1084 | 66 | 258 |
| | 11 | 422 | 39 | 377 | 67 | 449 |
| | 12 | 195 | 40 | 588 | 68 | 108 |
| | 13 | 275 | 41 | 866 | 69 | 682 |
| 20 min | 14 | 262 | 42 | 283 | 70 | 108 |
| | 15 | 329 | 43 | 1183 | 71 | 264 |
| | 16 | 456 | 44 | 747 | 72 | 260 |
| | 17 | 579 | 45 | 418 | 73 | 179 |
| 1 hr | 18 | 869 | 46 | 1430 | 74 | 867 |
| | 19 | 330 | 47 | 605 | 75 | 422 |
| | 20 | 269 | 48 | 499 | 76 | 254 |
| | 21 | 138 | 49 | 250 | 77 | 399 |
| 2 hr | 22 | BQL | 50 | 270 | 78 | 96.4 |
| | 23 | 132 | 51 | 295 | 79 | 438 |
| | 24 | 170 | 52 | 721 | 80 | 392 |
| | 25 | 228 | 53 | 278 | 81 | 179 |
| 4 hr | 26 | 81.9 | 54 | 262 | 82 | 174 |
| | 27 | 305 | 55 | 19.5 | 83 | 74.3 |
| | 28 | 428 | 56 | 766 | 84 | 665 |
| | 29 | 38.5 | 57 | 379 | 85 | 187 |

TABLE C-28-continued

Individual actual amount (BALF Concentration × recovered volume) of RSV NB2, ALX-0081, and RANKL008A in BALF after a single intratracheal administration of RSV NB2 (3.6 mg/kg), ALX-0081 (3.1 mg/kg) and RANKL008A (3.2 mg/kg) to male rats

| Nominal | BALF Actual Amount after i.t. Administration (μg) | | | | | |
|---|---|---|---|---|---|---|
| | RSV NB2 | | ALX-0081 | | RANKL008A | |
| Time | ID | Amount | ID | Amount | ID | Amount |
| 6/8 hr | 30 | 171 | 58 | 289 | 86 | 109 |
| | 31 | 305 | 59 | 811 | 87 | 274 |
| | 32 | 151 | 60 | 311 | 88 | 543 |
| | 33 | 281 | 61 | 634 | 89 | 272 |
| 24 hr | 34 | 62.0 | 62 | 157 | 90 | 262 |
| | 35 | 124 | 63 | 98.7 | 91 | 110 |
| | 36 | 80.0 | 64 | 140 | 92 | 59.9 |
| | 37 | 119 | 65 | 95.2 | 93 | 38.0 |

BQL: below the quantification limit

TABLE C-29

Mean actual amount (BALF Concentration × recovered volume) of RSV NB2, ALX-0081, and RANKL008A in BALF after a single intratracheal administration RSV NB2 (3.6 mg/kg), ALX-0081 (3.1 mg/kg) and RANKL008A (3.2 mg/kg) to male rats

| | BALF actual amount after i.t. Administration (μg) | | | | | |
|---|---|---|---|---|---|---|
| | RSV NB2 (ID 10-37) | | ALX-0081 (ID 38-65) | | RANKL008A (ID 66-93) | |
| Nominal Time | Average | SD | Average | SD | Average | SD |
| 4 min | 287 | 97 | 729 | 310 | 374 | 248 |
| 20 min | 406 | 140 | 658 | 401 | 203 | 74 |
| 1 hr | 401 | 322 | 696 | 512 | 485 | 265 |
| 2 hr | 177 | 48 | 391 | 220 | 276 | 165 |
| 4 hr | 213 | 185 | 357 | 311 | 275 | 265 |
| 6 hr | 227 | 77 | 512 | 254 | / | / |
| 8 hr | / | / | / | / | 299 | 180 |
| 24 hr | 96.5 | 30.4 | 123 | 30 | 117 | 101 |

TABLE C-30

Individual theoretical amount (BALF Concentration × 10 mL) normalized by dose (%) of RSV NB2, ALX-0081, and RANKL008A in BALF after a single intratracheal administration of RSV NB2 (3.6 mg/kg), ALX-0081 (3.1 mg/kg) and RANKL008A (3.2 mg/kg) to male rats

| | BALF Theoretical Amount normalized by dose (%) | | | | | |
|---|---|---|---|---|---|---|
| | RSV NB2 | | ALX-0081 | | RANKL008A | |
| Nominal Time | ID | Amount/D (%) | ID | Amount/D (%) | ID | Amount/D (%) |
| 4 min | 10 | 40.5 | 38 | 147 | 66 | 31.3 |
| | 11 | 57.0 | 39 | 58.8 | 67 | 54.4 |
| | 12 | 20.2 | 40 | 70.2 | 68 | 26.2 |
| | 13 | 32.2 | 41 | 117 | 69 | 77.8 |
| 20 min | 14 | 28.7 | 42 | 41.0 | 70 | 14.0 |
| | 15 | 48.1 | 43 | 150 | 71 | 85.4 |
| | 16 | 61.6 | 44 | 94.8 | 72 | 42.0 |
| | 17 | 59.7 | 45 | 56.5 | 73 | 21.8 |

TABLE C-30-continued

Individual theoretical amount (BALF Concentration × 10 mL) normalized by dose (%) of RSV NB2, ALX-0081, and RANKL008A in BALF after a single intratracheal administration of RSV NB2 (3.6 mg/kg), ALX-0081 (3.1 mg/kg) and RANKL008A (3.2 mg/kg) to male rats

| | BALF Theoretical Amount normalized by dose (%) | | | | | |
|---|---|---|---|---|---|---|
| | RSV NB2 | | ALX-0081 | | RANKL008A | |
| Nominal Time | ID | Amount/D (%) | ID | Amount/D (%) | ID | Amount/D (%) |
| 1 hr | 18 | 117.3 | 46 | 182 | 74 | 120 |
| | 19 | 44.5 | 47 | 81.8 | 75 | 68.3 |
| | 20 | 31.4 | 48 | 63.3 | 76 | 32.8 |
| | 21 | 16.2 | 49 | 36.3 | 77 | 48.4 |
| 2 hr | 22 | BQL | 50 | 34.3 | 78 | 15.6 |
| | 23 | 19.3 | 51 | 37.5 | 79 | 56.6 |
| | 24 | 22.9 | 52 | 113 | 80 | 47.6 |
| | 25 | 28.6 | 53 | 37.6 | 81 | 21.7 |
| 4 hr | 26 | 13.1 | 54 | 33.2 | 82 | 24.1 |
| | 27 | 53.4 | 55 | 2.48 | 83 | 11.1 |
| | 28 | 39.5 | 56 | 86.4 | 84 | 92.3 |
| | 29 | 4.22 | 57 | 51.3 | 85 | 24.2 |
| 6/8 hr | 30 | 21.4 | 58 | 36.7 | 86 | 15.1 |
| | 31 | 38.3 | 59 | 91.5 | 87 | 40.9 |
| | 32 | 18.9 | 60 | 52.7 | 88 | 70.3 |
| | 33 | 29.0 | 61 | 75.8 | 89 | 29.3 |
| 24 hr | 34 | 8.36 | 62 | 21.2 | 90 | 31.8 |
| | 35 | 16.8 | 63 | 13.4 | 91 | 14.2 |
| | 36 | 9.36 | 64 | 16.7 | 92 | 7.26 |
| | 37 | 15.0 | 65 | 14.9 | 93 | 6.71 |

BQL: below the quantification limit

TABLE C-31

Individual actual amount (BALF Concentration × recovered volume) normalized by dose (%) of RSV NB2 (3.6 mg/kg), ALX-0081 (3.1 mg/kg) and RANKL008A (3.2 mg/kg) in BALF after intratracheal administration

| | BALF Actual Amount normalized by dose (%) | | | | | |
|---|---|---|---|---|---|---|
| | RSV NB2 | | ALX-0081 | | RANKL008A | |
| Time | ID | Amount/D (%) | ID | Amount/D (%) | ID | Amount/D (%) |
| 4 min | 10 | 22.3 | 38 | 110 | 66 | 25.1 |
| | 11 | 37.0 | 39 | 38.2 | 67 | 43.6 |
| | 12 | 17.1 | 40 | 59.7 | 68 | 10.5 |
| | 13 | 24.1 | 41 | 87.9 | 69 | 66.2 |
| 20 min | 14 | 23.0 | 42 | 28.7 | 70 | 10.5 |
| | 15 | 28.8 | 43 | 120 | 71 | 25.6 |
| | 16 | 40.0 | 44 | 75.8 | 72 | 25.2 |
| | 17 | 50.8 | 45 | 42.4 | 73 | 17.4 |
| 1 hr | 18 | 76.3 | 46 | 145 | 74 | 84.1 |
| | 19 | 28.9 | 47 | 61.4 | 75 | 41.0 |
| | 20 | 23.6 | 48 | 50.6 | 76 | 24.6 |
| | 21 | 12.1 | 49 | 25.4 | 77 | 38.7 |
| 2 hr | 22 | BQL | 50 | 27.4 | 78 | 9.4 |
| | 23 | 11.6 | 51 | 30.0 | 79 | 42.5 |
| | 24 | 14.9 | 52 | 73.2 | 80 | 38.1 |
| | 25 | 20.0 | 53 | 28.2 | 81 | 17.3 |
| 4 hr | 26 | 7.19 | 54 | 26.6 | 82 | 16.9 |
| | 27 | 26.7 | 55 | 1.98 | 83 | 7.21 |
| | 28 | 37.5 | 56 | 77.8 | 84 | 64.6 |
| | 29 | 3.37 | 57 | 38.5 | 85 | 18.1 |
| 6/8 hr | 30 | 15.0 | 58 | 29.4 | 86 | 10.6 |
| | 31 | 26.8 | 59 | 82.3 | 87 | 26.6 |
| | 32 | 13.2 | 60 | 31.6 | 88 | 52.7 |
| | 33 | 24.6 | 61 | 64.4 | 89 | 26.4 |

TABLE C-31-continued

Individual actual amount (BALF Concentration × recovered volume) normalized by dose (%) of RSV NB2 (3.6 mg/kg), ALX-0081 (3.1 mg/kg) and RANKL008A (3.2 mg/kg) in BALF after intratracheal administration

| | BALF Actual Amount normalized by dose (%) | | | | | |
|---|---|---|---|---|---|---|
| | RSV NB2 | | ALX-0081 | | RANKL008A | |
| Time | ID | Amount/D (%) | ID | Amount/D (%) | ID | Amount/D (%) |
| 24 hr | 34 | 5.44 | 62 | 15.9 | 90 | 25.4 |
| | 35 | 10.9 | 63 | 10.0 | 91 | 10.6 |
| | 36 | 7.02 | 64 | 14.2 | 92 | 5.81 |
| | 37 | 10.5 | 65 | 9.66 | 93 | 3.69 |

BQL: below the quantification limit

TABLE C-32

Mean (+SD) theoretical amount (BALF Concentration × 10 mL) normalized by dose (%) of RSV NB2 (3.6 mg/kg), ALX-0081 (3.1 mg/kg) and RANKL008A (3.2 mg/kg) in BALF after intratracheal administration

| | BALF theoretical amount/Dose (%) | | | | | |
|---|---|---|---|---|---|---|
| | RSV NB2 (ID 10-37) | | ALX-0081 (ID 38-65) | | RANKL008A (ID 66-93) | |
| Time | Average | SD | Average | SD | Average | SD |
| 4 min | 37.5 | 15.5 | 98.3 | 41.0 | 47.5 | 23.7 |
| 20 min | 49.5 | 15.1 | 85.6 | 48.6 | 40.8 | 32.0 |
| 1 hr | 52.3 | 44.8 | 90.7 | 63.3 | 67.4 | 38.0 |
| 2 hr | 23.6 | 4.7 | 55.5 | 38.1 | 35.4 | 19.8 |
| 4 hr | 27.6 | 22.9 | 43.4 | 35.1 | 37.9 | 36.8 |
| 6 hr | 26.9 | 8.7 | 64.2 | 24.3 | / | / |
| 8 hr | / | / | / | / | 38.9 | 23.4 |
| 24 hr | 12.4 | 4.1 | 16.5 | 3.4 | 15.0 | 11.7 |

TABLE C-33

Mean actual amount (BALF Concentration × recovered volume) normalized by dose (%) of RSV NB2 (3.6 mg/kg), ALX-0081 (3.1 mg/kg) and RANKL008A (3.2 mg/kg) in BALF after intratracheal administration

| | BALF actual amount/Dose (%) | | | | | |
|---|---|---|---|---|---|---|
| | RSV NB2 (ID 10-37) | | ALX-0081 (ID 38-65) | | RANKL008A (ID 66-93) | |
| Time | Average | SD | Average | SD | Average | SD |
| 4 min | 25.1 | 8.5 | 74.0 | 31.5 | 36.3 | 24.1 |
| 20 min | 35.7 | 12.3 | 66.8 | 40.7 | 19.7 | 7.2 |
| 1 hr | 35.2 | 28.2 | 70.7 | 51.9 | 47.1 | 25.7 |
| 2 hr | 15.5 | 4.2 | 39.7 | 22.3 | 26.8 | 16.0 |
| 4 hr | 18.7 | 16.2 | 36.2 | 31.6 | 26.7 | 25.7 |
| 6 hr | 19.9 | 6.8 | 51.9 | 25.8 | / | / |
| 8 hr | / | / | / | / | 29.1 | 17.5 |
| 24 hr | 8.46 | 2.66 | 12.5 | 3.1 | 11.4 | 9.8 |

TABLE C-34

Alternative screening of NANOBODIES ® ($V_{HH}$ sequences) described in Example 44

| Clone | SEQ ID NO: | Llama | Selection | Family | Previous screen | Epitope | % Binding RSV-A Fold blanc | % Binding Hep2-B1 1;50 PE | % Binding Hep2-B1 1;200 PE | % Inhibition 101F Fab 1;100 PE | % Inhibition 101F Fab 1;300 PE | % Inhibition 101F Fab 1;1000 PE | % Inhibition Synagis 1:10 PE |
|---|---|---|---|---|---|---|---|---|---|---|---|---|---|
| PMP8A1 | 249 | 206 | R1 trypsin | 1 | | 101F | 3.7 | 98% | 92% | nd | 55% | 20% | |
| PMP8B10 | 342 | 207 | R1 trypsin | 11 | | 101F | 3.5 | 94% | 84% | 56% | 31% | 6% | |
| PMP13A1 | 274 | 206 | R1 + 2 101F | 4sub1 | | 101F | 2.9 | 84% | 65% | 74% | 46% | 13% | |
| PMP13B4 | 318 | 206 | R1 + 2 101F | 5 | | 101F | 2.7 | 75% | 56% | 82% | 47% | 20% | |
| PMP13C1 | 278 | 206 | R1 + 2 101F | 4sub1 | | 101F | 3.0 | 104% | 86% | 57% | 37% | 9% | |
| PMP19E2 | 301 | 206 | R1 101F; R2 peptide | 4sub2 | | 101F | 3.5 | 87% | 58% | 74% | 27% | 5% | |
| PMP13D1 | 308 | 206 | R1 + 2 101F | 4sub3 | | 101F | 3.1 | 93% | 75% | 78% | 52% | 16% | |
| PMP13E12 | 2580 | 207 | R1 + 2 101F | 14 | | 101F | 3.7 | 97% | 75% | 74% | 28% | 8% | |
| PMP23E5 | 365 | 212 | R1 + 2 RSV 101F | 23 | | 101F | 3.4 | 103% | 82% | 37% | 16% | nd | |
| PMP1B2 | 166 | 156 | R1 RSV trypsin | LG21 | LG191E4 | 101F | 3.8 | 88% | 85% | 82% | 58% | 25% | |
| PMP1A2 | 389 | 156 | R1 RSV trypsin | LG34 | | 101F | 4.0 | 86% | 66% | 82% | 27% | 5% | |
| PMP7B2 | 354 | 212 | R1 trypsin | 16 | | Synagis | 4.7 | 61% | 41% | | | | 70% |
| PMP19C4 | 371 | 207 | R1 101F; R2 peptide | 29 | 15H8 | Synagis | 2.5 | 72% | 50% | | | | 39% |
| PMP1A6 | 404 | 156 | R1 RSV trypsin | LG | | Synagis | 4.2 | 57% | 39% | | | | 67% |
| PMP1G8 | 2578 | 156 | R1 RSV trypsin | LG | | Synagis | 3.7 | 73% | 43% | | | | 57% |
| PMP1E4 | 211 | 156 | R1 RSV trypsin | LG3-2 | | Synagis | 3.6 | 55% | 55% | | | | 55% |
| PMP1G3 | 159 | 156 | R1 RSV trypsin | LG3-2 | LG191D3 | Synagis | 3.4 | 52% | 45% | | | | 52% |
| PMP1E5 | 167 | 156 | R1 RSV trypsin | LG3-1 | | Synagis | 3.4 | 54% | 37% | | | | 41% |
| PMP20B2 | 2576 | 156 | R1 101F | LG3-1 | | Synagis | 3.0 | 32% | 32% | | | | 33% |
| PMP20C1 | 2577 | 156 | R1 101F | LG40 | | Synagis | 2.7 | 37% | 35% | | | | 33% |

TABLE C-35

Overview of immunizations, sampling and neutralizing antibody titers of the llamas.

| Date | Day | Immunisation experiment 75a, Cocktail nr C127, Llama 183 | Immunisation experiment 75b, Cocktail nr C127, Llama 196 | Tissue collection | RFFIT titer (50% dilution) Llama 183 | RFFIT titer (50% dilution) Llama 196 |
|---|---|---|---|---|---|---|
| Start immunisation | | | | | | |
| Day 25/07/07 | 0 | 2.5 IU | 2.5 IU | 10 ml pre-immune blood | <0.50 IU/ml (<1/9) | <0.50 IU/ml (<1/9) |
| Day 01/08/07 | 7 | 2.5 IU | 2.5 IU | — | | |
| Day 21/08/07 | 27 | | | 10 ml immune blood | 2 IU/ml (1/66) | 6 IU/ml (1/179) |
| Day 22/08/07 | 28 | 2.5 IU | 2.5 IU | — | | |
| Day 29/08/07 | 35 | 2.5 IU | 2.5 IU | | | |
| Day 31/08/07 | 37 | | | 10 ml immune blood | 22 IU/ml (1/674) | 27 IU/ml (1/789) |
| Day 05/09/07 | 42 | | | 150 ml immune blood (PBL1) lymph node biopsy: unsuccessful | 37 IU/ml (1/989) | 33 IU/ml (1/896) |
| Day 12/09/07 | 49 | | | 150 ml immune blood (PBL2) | 22.72 IU/ml (1/674) | 14.86 IU/ml (1/441) |
| Day 20/09/07 | 57 | 2.5 IU | 2.5 IU | | | |
| Day 25/09/07 | 62 | | | 150 ml immune blood (PBL3) | 22.25 IU/ml (1/673) | 35.35 IU/ml (1/1071) |

TABLE C-36

In vitro neutralizing potency of monovalent Nanobody clones with the RFFIT assay

| Nanobody | | CVS-11 neutralizing antibody titer ATCC VR 959, sequence G protein: NCBI EU126641 | | | | |
|---|---|---|---|---|---|---|
| Clone | Elusion | 50% dilution | IU[a]/ml | IU/mg | IU/μM[b] | nM $IC_{50}$[c] |
| Mab 8-2 | Ascites mouse | 1/303250 | 10108.33 | nd[d] | nd | nd |
| Mab RV1C5 | 100 μg $IgG_{2a}$/ml PBS (Santa Cruz sc-57995) | 1/4985 | 165.15 | 1651.5 | 193500 | 0.17 |
| 214-C10 | trypsin 1st + mab 2[d] round | 1/122 | 4.24 | 10.60 | 0.16 | 219.67 |
| 214-F8 | trypsin 1st + mab 2[d round] | 1/33 | 1.15 | 7.19 | 0.11 | 324.85 |
| 214-A8 | trypsin 1st + mab 2[d] round | 1/263 | 9.12 | 7.93 | 0.12 | 292.97 |
| 214-E8 | trypsin[st] + mab 2[d] round | 1/140 | 4.87 | 9.37 | 0.14 | 248.86 |
| 213-E6 | Mab 1st + trypsin 2[d] round | 1/3238 | 112.33 | 170.20 | 2.54 | 13.66 |
| 213-B7 | Mab 1st + trypsin 2[d] round | 1/140 | 4.87 | 7.38 | 0.11 | 315.86 |
| 213-D7 | Mab 1st + trypsin 2[d] round | 1/147 | 5.10 | 7.61 | 0.11 | 305.37 |
| 213-D6 | Mab 1st + trypsin 2[d] round | <1/9 | <0.50 | <0.48 | <0.01 | >7816.67 |
| 213-H7 | Mab 1st + trypsin 2[d] round | 1/49 | 1.71 | 12.21 | 0.18 | 191.43 |
| 192-C4 | Anti HRSV[e] | <1/9 | <0.50 | <0.63 | <0.01 | >5881.11 |
| 192-A8 | Anti HRSV | <1/9 | <0.50 | <0.77 | <0.02 | >4838.89 |
| 191-E4 | Anti HRSV | <1/9 | <0.50 | <0.63 | <0.01 | >5955.56 |
| 212-A2 | Trypsin 1st and 2[d] round | 1/47 | 1.62 | 1.72 | 0.03 | 1340.00 |
| 212-B2 | Trypsin 1st and 2[d] round | 1/75 | 2.60 | 3.66 | 0.05 | 634.27 |
| 212-G2 | Trypsin 1st and 2[d] round | 1/263 | 9.12 | 9.31 | 0.14 | 249.66 |
| 212-F6 | Trypsin 1st and 2[d] round | 1/4057 | 122.43 | 114.42 | 1.71 | 17.67 |
| 212-B12 | Trypsin 1st and 2[d] round | 1/1028 | 31.00 | 20.00 | 0.30 | 101.02 |
| 212-C12 | Trypsin 1st and 2[d] round | 1/11363 | 394.26 | 308.02 | 4.60 | 7.55 |
| 214-H10 | trypsin 1st + mab 2[d] round | 1/330 | 11.44 | 8.17 | 0.12 | 284.24 |

[a]International Unit (IU)
[b]1 mg nanobody/ml = 67 μM
[c]= mg/ml × 50% dilution × 67000
[d]not determined
[e]human respiratory syncytial virus

TABLE C-37

Effect of combinations of Nanobodies on the neutralizing potency compared to single Nanobodies.

| | CVS neutralizing antibody titer strain CVS-11, ATCC VR 959, sequence G protein: NCBI EU126641 | | | | |
|---|---|---|---|---|---|
| Combinations of Nanobodies | 50% dilution | IU[a]/ml | IU/mg | IU/μM[b] | nM $IC_{50}$[c] |
| 10 μl 212-C12 + 10 μl medium | 1/19426 | 643.58 | 205.62 | 3.07 | 10.80 |
| 10 μl medium + 10 μl 213-E6 | 1/2987 | 98.64 | 65.76 | 0.98 | 33.65 |
| 10 μl 212-C12 + 10 μl 213-E6 | 1/10757 | 356.35 | 153.93 | 2.30 | 14.42 |
| 10 μl 212-C12 + 10 μl medium | 1/8302 | 232.64 | 85.85 | 1.28 | 21.87 |
| 10 μl medium + 10 μl 213-H7 | 1/150 | 4.22 | 30.14 | 0.45 | 62.53 |
| 10 μl 212-C12 + 10 μl 213-H7 | 1/4346 | 122.3 | 85.52 | 1.28 | 22.05 |
| 10 μl 212-C12 + 10 μl medium | 1/21220 | 597.18 | 220.36 | 3.29 | 8.56 |
| 10 μl medium + 10 μl 214-E8 | 1/280 | 7.38 | 14.19 | 0.21 | 124.43 |
| 10 μl 212-C12 + 10 μl 214-E8 | 1/8635 | 243.01 | 150.01 | 2.24 | 12.57 |
| 10 μl 212-C12 + 10 μl medium | 1/14380 | 404.70 | 149.34 | 2.23 | 12.63 |
| 10 μl medium + 10 μl 172-B3[d] | <1/9 | <0.50 | <0.14 | <0.01 | >26948.89 |
| 10 μl 212-C12 + 10 μl 172-B3 | 1/8902 | 250.54 | 79.03 | 1.18 | 23.86 |
| 10 μl 214-E8 + 10 μl medium | 1/178 | 5.26 | 10.12 | 0.15 | 195.73 |
| 10 μl medium + 10 μl 213-H7 | 1/60 | 1.76 | 12.57 | 0.19 | 156.33 |
| 10 μl 214-E8 + 10 μl 213-H7 | 1/131 | 3.88 | 11.76 | 0.18 | 168.78 |
| 10 μl 214-E8 + 10 μl medium | 1/108 | 3.18 | 6.12 | 0.09 | 322.59 |
| 10 μl medium + 10 μl 213-E6 | 1/5252 | 155.78 | 83.75 | 1.25 | 23.73 |
| 10 μl 214-E8 + 10 μl 213-E6 | 1/2022 | 59.96 | 50.39 | 0.75 | 39.43 |
| 10 μl 214-H10 + 10 μl medium | 1/842 | 24.96 | 17.83 | 0.27 | 111.40 |
| 10 μl medium + 10 μl 213-E6 | 1/6166 | 182.84 | 98.30 | 1.47 | 20.21 |
| 10 μl 214-H10 + 10 μl 213-E6 | 1/1611 | 47.8 | 29.33 | 0.44 | 67.79 |

[a]International Unit (IU)
[b]1 mg Nanobody/ml = 67 μM
[c]= mg/ml × 50% dilution × 67000
[d]172-B3 = control Nanobody directed against TLR-3

TABLE C-38

Cross-neutralisation potency of monovalent Nanobody clones: neutralization of the genotype 1 ERA strain

| Sample | | ERA neutralizing antibody titer Attenuated vaccine strain, ATCC VR332, complete genome: NCBI EF206707 88% nucleotide identity with G of CVS-11 | | | | | Interpretation cross- |
|---|---|---|---|---|---|---|---|
| Clone | Elusion | 50% dilution | EU[a]/ml | EU/mg | EU/μM[b] | nM $IC_{50}$[c] | neutralisation |
| Mab 8-2 | Ascites mouse | 1/506795 | 16895.00 | nd[d] | nd | nd | Yes |
| OIE 0.5 IU/ml | Canine reference serum | 1/47 | 1.56 | nd | nd | nd | 3 x stronger compared to CVS |
| WHO 0.5 IU/ml | Human reference serum | 1/20 | 0.66 | nd | nd | nd | Similar to CVS |
| WHO 6 IU/ml | Human reference serum | 1/192 | 6.40 | nd | nd | nd | Similar to CVS |
| 192-C4 | Anti-HRSV[e] | <1/9 | <0.50 | <0.63 | <0.01 | >5881.11 | No |
| 192-A8 | Anti-HRSV | <1/9 | <0.50 | <0.77 | <0.02 | >4838.89 | No |
| 191-E4 | Anti-HRSV | <1/9 | <0.50 | <0.63 | <0.01 | >5955.56 | No |
| 214-C10 | Anti-rabies[f] | 1/421 | 14.03 | 35.08 | 0.52 | 63.66 | Yes |
| 214-F8 | Anti-rabies | 1/114 | 3.81 | 23.81 | 0.36 | 94.04 | Yes |
| 214-A8 | Anti-rabies | <1/9 | <0.50 | <0.43 | <0.01 | >8561.11 | No |
| 214-E8 | Anti-rabies | <1/9 | <0.50 | <0.96 | <0.02 | >3871.11 | No |
| 213-E6 | Anti-rabies | 1/8635 | 287.83 | 154.75 | 2.31 | 14.43 | Yes |
| 213-B7 | Anti-rabies | 1/165 | 5.51 | 8.35 | 0.12 | 268.00 | Yes |
| 213-D7 | Anti-rabies | 1/179 | 5.97 | 8.91 | 0.13 | 250.78 | Yes |
| 213-D6 | Anti-rabies | <1/9 | <0.50 | <0.48 | <0.01 | >7816.67 | No |
| 213-H7 | Anti-rabies | 1/367 | 12.23 | 87.36 | 1.30 | 25.56 | Yes |
| 212-A2 | Anti-rabies | 1/16 | 0.52 | 0.55 | 0.01 | 3936.25 | Yes |
| 212-B2 | Anti-rabies | 1/55 | 1.84 | 2.59 | 0.04 | 864.91 | Yes |
| 212-G2 | Anti-rabies | <1/9 | <0.50 | <0.51 | <0.01 | >7295.56 | No |
| 212-F6 | Anti-rabies | 1/30 | 0.99 | 0.93 | 0.01 | 2389.67 | Yes |
| 212-B12 | Anti-rabies | 1/14 | 0.45 | 0.29 | <0.01 | 7417.86 | No |
| 212-C12 | Anti-rabies | 1/27367 | 912.23 | 336.62 | 5.02 | 6.63 | Yes |
| 214-H10 | Anti-rabies | <1/9 | <0.50 | <0.36 | <0.01 | >10422.22 | No |

[a]1 Equivalent Unit (EU) is comparable to the neutralizing potency of 1 International Unit (IU)
[b]1 mg nanobody/ml = 67 μM
[c]= mg/ml × 50% dilution × 67000
[d]not determined
[e]control Nanobody raised against human respiratory syncytial virus
[f]Nanobody raised against rabies virus

TABLE C-39

Cross-neutralisation potency of monovalent Nanobody clones: neutralization of wild type genotype 1 strain CB-1

| | | Chien Beersel-1 (CB-1) neutralizing antibody titer Belgian isolate of a genotype 1 canine rabies virus (Le Roux I. & Van Gucht S, WHO Rabies Bulletin 2008, 32(1), Quarter 1) | | | | | Interpretation cross- |
|---|---|---|---|---|---|---|---|
| Nanobody | | 50% dilution | EU[a]/ml | EU/mg | EU/μM[b] | nM $IC_{50}$[c] | neutralisation |
| Mab 8-2 | Ascites mouse | 1/881758 | 29391.92 | nd[d] | nd | nd | Very strong |
| OIE 0.5 IU/ml | Canine reference serum | 1/36 | 1.18 | nd | nd | nd | 2 x stronger compared to CVS |
| WHO 0.5 IU/ml | Human reference serum | 1/47 | 1.56 | nd | nd | nd | 3 x stronger compared to CVS |
| WHO 6 IU/ml | Human reference serum | 1/402 | 13.40 | nd | nd | nd | 2 x stronger compared to CVS |
| 192-C4 | Anti-HRSV[e] | <1/9 | <0.50 | <0.63 | <0.01 | >5881.11 | Absent |
| 192-A8 | Anti-HRSV | <1/9 | <0.50 | <0.77 | <0.011 | >4838.89 | Absent |
| 191-E4 | Anti-HRSV | <1/9 | <0.50 | <0.63 | <0.01 | >5955.56 | Absent |
| 214-C10 | Anti-rabies[f] | 1/653 | 21.77 | 54.43 | 0.81 | 41.04 | Strong |
| 214-F8 | Anti-rabies | 1/593 | 19.78 | 123.63 | 1.85 | 18.08 | Very strong |
| 214-A8 | Anti-rabies | 1/2768 | 92.25 | 80.22 | 1.20 | 27.84 | Strong |
| 214-E8 | Anti-rabies | 1/1906 | 63.55 | 122.21 | 1.82 | 18.28 | Very strong |
| 213-E6 | Anti-rabies | 1/10610 | 353.66 | 535.85 | 8.00 | 4.17 | Very strong |
| 213-B7 | Anti-rabies | 1/1263 | 42.09 | 63.77 | 0.95 | 35.01 | Strong |
| 213-D7 | Anti-rabies | 1/1996 | 66.52 | 99.28 | 1.48 | 22.49 | Strong |
| 213-D6 | Anti-rabies | 1/73 | 2.42 | 2.30 | 0.034 | 963.70 | Weak |
| 213-H7 | Anti-rabies | 1/8902 | 296.74 | 2119.57 | 31.64 | 1.05 | Very strong |
| 212-A2 | Anti-rabies | 1/524 | 17.48 | 18.60 | 0.28 | 120.19 | Strong |
| 212-B2 | Anti-rabies | 1/1384 | 46.12 | 64.96 | 0.97 | 34.37 | Strong |
| 212-G2 | Anti-rabies | 1/483 | 16.09 | 16.42 | 0.25 | 135.94 | Strong |
| 212-F6 | Anti-rabies | 1/1959 | 65.32 | 61.05 | 0.91 | 36.60 | Strong |
| 212-B12 | Anti-rabies | 1/11364 | 378.80 | 244.39 | 3.65 | 9.14 | Very strong |

TABLE C-39-continued

Cross-neutralisation potency of monovalent Nanobody clones: neutralization of wild type genotype 1 strain CB-1

| Nanobody | | Chien Beersel-1 (CB-1) neutralizing antibody titer Belgian isolate of a genotype 1 canine rabies virus (Le Roux I. & Van Gucht S, WHO Rabies Bulletin 2008, 32(1), Quarter 1) 50% dilution | EU[a]/ml | EU/mg | EU/μM[b] | nM $IC_{50}$[c] | Interpretation cross-neutralisation |
|---|---|---|---|---|---|---|---|
| 212-C12 | Anti-rabies | 1/17635 | 587.84 | 459.25 | 6.85 | 4.86 | Very strong |
| 214-H10 | Anti-rabies | 1/4985 | 166.18 | 118.70 | 1.77 | 18.82 | Very strong |

[1]Equivalent Unit (EU) is comparable to the neutralizing potency of 1 International Unit (IU)

[b]1 mg nanobody/ml = 67 μM

[c]= mg/ml × 50% dilution × 67000

[d]not applicable

[e]control Nanobody raised against human respiratory syncytial virus

[f]Nanobody raised against rabies virus

TABLE C-40

Cross-neutralisation potency of monovalent and bivalent Nanobody clones: neutralization of EBLV-1 strain

| Sample | | EBLV-1 neutralizing antibody titer Genotype 5, strain 8918FRA, complete genome: NCBI EU293112 71% nucleotide identity with G of CVS-11 | | | | | Interpretation cross- |
|---|---|---|---|---|---|---|---|
| Clone | Elusion | 50% dilution | EU[b]/ml | EU/mg | EU/μM[c] | nM $IC_{50}$[d] | neutralisation |
| Mab 8-2 | Ascites mouse | 1/627878 | 20929.27 | na | na | na | Yes |
| OIE 0.5 IU/ml | Canine reference serum | <1/9 | <0.50 | na | na | na | No |
| WHO 0.5 IU/ml | Human reference serum | <1/9 | <0.50 | na | na | na | No |
| WHO 6 IU/ml | Human reference serum | 1/37 | 1.22 | na | Na | na | 5x weaker compared to CVS-11 |
| 214-C10 | trypsin 1st + mab 2[d] round | <1/9 | <0.50 | <1.25 | <0.02 | >2977.78 | No |
| 214-F8 | trypsin 1st + mab 2[d] round | <1/9 | <0.50 | <3.13 | <0.05 | >1191.11 | No |
| **214-A8** | trypsin 1st + mab 2[d] round | 1/25 | 0.83 | 0.72 | 0.02 | 3082.00 | **Yes** |
| **214-E8** | trypsin[st] + mab 2[d] round | 1/67 | 2.25 | 4.33 | 0.06 | 520.00 | **Yes** |
| 213-E6 | Mab 1st + trypsin 2[d] round | <1/9 | <0.50 | <0.76 | <0.02 | >4913.33 | No |
| **213-B7** | Mab 1st + trypsin 2[d] round | 1/38 | 1.27 | 1.92 | 0.03 | 1163.68 | **Yes** |
| **213-D7** | Mab 1st + trypsin 2[d] round | 1/41 | 1.38 | 2.06 | 0.03 | 1094.88 | **Yes** |
| 213-D6 | Mab 1st + trypsin 2[d] round | <1/9 | <0.50 | <0.48 | <0.01 | >7816.67 | No |
| **213-H7** | Mab 1st + trypsin 2[d] round | 1/16 | 0.52 | 3.71 | 0.06 | 586.25 | **Yes** |
| 192-C4 | Anti HRSV | <1/9 | <0.50 | <0.63 | <0.01 | >5881.11 | No |
| 192-A8 | Anti HRSV | <1/9 | <0.50 | <0.77 | <0.02 | >4838.89 | No |
| 191-E4 | Anti HRSV | <1/9 | <0.50 | <0.63 | <0.01 | >5955.56 | No |
| **212-A2** | Trypsin 1st and 2[d] round | 1/25 | 0.83 | 0.88 | 0.01 | 2519.20 | **Yes** |
| 212-B2 | Trypsin 1st and 2[d] round | <1/9 | <0.50 | <0.70 | <0.02 | >5285.56 | No |
| 212-G2 | Trypsin 1st and 2[d] round | <1/9 | <0.50 | <0.51 | <0.01 | >7295.56 | No |
| 212-F6 | Trypsin 1st and 2[d] round | <1/9 | <0.50 | <0.47 | <0.01 | >7965.56 | No |
| 212-B12 | Trypsin 1st and 2[d] round | <1/9 | <0.50 | <0.32 | <0.01 | >11538.89 | No |
| 212-C12 | Trypsin 1st and 2[d] round | <1/9 | <0.50 | <0.39 | <0.01 | >9528.89 | No |
| **214-H10** | trypsin 1st + mab 2[d] round | 1/41 | 1.36 | 0.97 | 0.01 | 2287.80 | **Yes** |
| 212-C12 15GS 212-C12 | | <1/9 | <0.50 | <0.50 | <0.013 | >4166.61 | No |
| 213-E6 5GS 213-E6 | | <1/9 | <0.50 | <0.53 | <0.028 | >4001.35 | No |
| **213-E6 15GS 213-H7** | | 1/63 | 2.04 | 4.86 | 0.14 | 236.70 | **Yes** |
| **214-E8 15GS 213-H7** | | 1/2187 | 70.15 | 305 | 8.52 | 3.76 | **Yes (potent)** |
| **213-H7 15GS 214-F8** | | 1/41 | 1.32 | 11 | 0.30 | 107.74 | **Yes** |

[a]serial dilution with different tips

[b]1 Equivalent Unit (EU) can inhibit 50% of $10^{4.54}$ $TCID_{50}$ of EBLV-1 on BHK cells; this is comparable to the neutralizing potency of 1 International Unit (IU) against CVS-11

[c]1 mg Nanobody/ml = 67 μM

[d]= mg/ml × 50% dilution × 67000

[e]not applicable

TABLE C-41

Cross-neutralisation potency of monovalent and bivalent Nanobody clones: neutralization of wild type genotype 1 strains and a laboratory CVS strain in suspensions of infected mouse brain using neuroblastoma cells as the susceptible target system

| Nanobody | | Virus titer ($TICD_{50}$[a]/ml) in brain suspension infected with strain . . . after pre-incubation with Nanobody | | | | | | |
|---|---|---|---|---|---|---|---|---|
| | | 9912CBG Dog Cambodia | 9147FRA Fox France | CVS Strain IP13 | 9722POL Raccoon dog Poland | 8740THA Human Thailand | 07059IC Dog Ivory Coast | 9009NIG Dog Niger |
| 172-B3 | Anti-TLR3 | 4582 | 1125 | ≥632456 | 2730 | 805 | 6325 | 780 |
| Mab 8-2 | Anti-rabies | ≤80[b] | ≤67 | 169643 | ≤70 | ≤63 | ≤63 | ≤63 |
| 214-F8 | Anti-rabies | ≤78 | ≤63 | 1465 | ≤63 | ≤63 | ≤75 | ≤70 |
| 213-E6 | Anti-rabies | ≤63 | ≤63 | ≤63 | ≤63 | ≤63 | ≤63 | 719 |
| 213-H7 | Anti-rabies | 379 | ≤63 | 170 | ≤63 | ≤63 | 155 | ≤78 |
| 212-C12 | Anti-rabies | 733 | 5750 | 2000 | 1411 | ≤78 | 452 | ≤69 |
| 212-C12-15GS-212-C12 | | ≤63 | | | | | ≤63 | ≤63 |
| 213-E6-5GS-213-E6 | | ≤63 | | | | | ≤63 | ≤63 |
| 213-E6-15GS-213-H7 | | ≤63 | | | | | ≤63 | ≤63 |
| 214-E8-15GS-213-H7 | | ≤63 | | | | | ≤63 | ≤63 |
| 213-H7-15GS-214-F8 | | ≤63 | | | | | ≤63 | ≤63 |

[a] Tissue Culture Infectious Dose 50%: this corresponds with the dilution of the infected brain suspension - Nanobody mixture which yields 50% infection in neuroblastoma cells

[b] Titers with grey background correspond with a minimum hundredfold reduction of virus infectivity compared to control clone 172-B3 (anti-TLR3)

TABLE C-42

Overview of the neutralisation potency of monovalent and bivalent Nanobody clones: neutralization profile against different rabies virus strains and isolates.

| Nanobody | | Neutralisation[a] of Genotype 1 | | | | | | | | | | |
|---|---|---|---|---|---|---|---|---|---|---|---|---|
| | | CVS | ERA | CB-1 | 9912CBG Dog Cambodia | 9147FRA Fox France | CVS Strain IP13 | 9722POL Raccoon dog Poland | 8740THA Human Thailand | 07059IC Dog Ivory Coast | 9009NIG Dog Niger | Genotype 5 EBLV-1 |
| Mab 8-2 | Ascites mouse | **Yes**[b] | **Yes** | **Yes** | **Yes** | **Yes** | No | **Yes** | **Yes** | **Yes** | **Yes** | **Yes** |
| OIE 0.5 IU/ml | Canine ref. serum | Yes | Yes | Yes | nt[c] | nt | nt | nt | nt | nt | nt | No |
| WHO 0.5 IU/ml | Human ref. serum | Yes | Yes | Yes | nt | nt | nt | nt | nt | nt | nt | No |
| WHO 6 IU/ml | Human ref. serum | Yes | Yes | Yes | nt | nt | nt | nt | nt | nt | nt | Yes |
| 192-C4 | Anti-HRSV[d] | No | No | No | nt | nt | nt | nt | nt | nt | nt | No |
| 192-A8 | Anti-HRSV | No | No | No | nt | nt | nt | nt | nt | nt | nt | No |
| 191-E4 | Anti-HRSV | No | No | No | nt | nt | nt | nt | nt | nt | nt | No |
| 172-B3 | Anti-TLR3[e] | No | nt | nt | No | No | No | No | No | No | No | nt |
| 214-F8 | Anti-rabies | Yes | Yes | **Yes** | **Yes** | **Yes** | Yes | **Yes** | **Yes** | **Yes** | **Yes** | No |
| 213-E6 | Anti-rabies | **Yes** | **Yes** | **Yes** | **Yes** | **Yes** | **Yes** | **Yes** | **Yes** | **Yes** | No | No |
| 213-H7 | Anti-rabies | Yes | Yes | **Yes** | No | **Yes** | Yes | **Yes** | **Yes** | No | **Yes** | Yes |
| 212-C12 | Anti-rabies | **Yes** | **Yes** | **Yes** | No | No | Yes | No | **Yes** | Yes | **Yes** | No |
| 214-E8 | Anti-rabies | Yes | No | Yes | nt | nt | nt | nt | nt | nt | nt | Yes |
| 214-C10 | Anti-rabies | Yes | Yes | Yes | nt | nt | nt | nt | nt | nt | nt | No |
| 214-A8 | Anti-rabies | Yes | No | Yes | nt | nt | nt | nt | nt | nt | nt | Yes |
| 213-B7 | Anti-rabies | Yes | Yes | Yes | nt | nt | nt | nt | nt | nt | nt | Yes |
| 213-D7 | Anti-rabies | Yes | Yes | Yes | nt | nt | nt | nt | nt | nt | nt | Yes |
| 213-D6 | Anti-rabies | No | No | Yes | nt | nt | nt | nt | nt | nt | nt | No |
| 212-A2 | Anti-rabies | Yes | Yes | Yes | nt | nt | nt | nt | nt | nt | nt | Yes |
| 212-B2 | Anti-rabies | Yes | Yes | Yes | nt | nt | nt | nt | nt | nt | nt | No |
| 212-G2 | Anti-rabies | Yes | No | Yes | nt | nt | nt | nt | nt | nt | nt | No |
| 212-F6 | Anti-rabies | **Yes** | Yes | Yes | nt | nt | nt | nt | nt | nt | nt | No |
| 212-B12 | Anti-rabies | Yes | No | **Yes** | nt | nt | nt | nt | nt | nt | nt | No |
| 214-H10 | Anti-rabies | Yes | No | **Yes** | nt | nt | nt | nt | nt | nt | nt | Yes |
| 212-C12 15GS 212-C12 | | **Yes** | nt | nt | **Yes** | nt | nt | nt | nt | **Yes** | **Yes** | **EBLV-1** |
| 213-E6 5GS 213-E6 | | **Yes** | nt | nt | **Yes** | nt | nt | nt | nt | **Yes** | **Yes** | No |
| 213-E6 15GS 213-H7 | | **Yes** | nt | nt | **Yes** | nt | nt | nt | nt | **Yes** | **Yes** | Yes |
| 214-E8 15GS 213-H7 | | **Yes** | nt | nt | **Yes** | nt | nt | nt | nt | **Yes** | **Yes** | **Yes** |

TABLE C-42-continued

Overview of the neutralisation potency of monovalent and bivalent Nanobody clones: neutralization profile against different rabies virus strains and isolates.

| Nanobody | Neutralisation[a] of Genotype 1 CVS | ERA | CB-1 | 9912CBG Dog Cambodia | 9147FRA Fox France | CVS Strain IP13 | 9722POL Raccoon dog Poland | 8740THA Human Thailand | 07059IC Dog Ivory Coast | 9009NIG Dog Niger | Genotype 5 EBLV-1 |
|---|---|---|---|---|---|---|---|---|---|---|---|
| 213-H7 15GS 214-F8 | **Yes** | nt | nt | **Yes** | nt | nt | nt | nt | **Yes** | **Yes** | Yes |

[a]Neutralisation is defined as an RFFIT titer of ≥0.50 IU or EU/ml (CVS, ERA, CB-1, EBLV-1), or a minimum hundredfold reduction of virus infectivity of a mixture of infected brain and nanobody in the neuroblastoma assay

[b]Yes in bold means a relative strong neutralizing potency: ≥100 IU or EU/mg in the RFFIT assay or ≤100 $TCID_{50}$/ml in the neuroblastoma assay

[c]Not tested

[d]Control Nanobody raised against human respiratory syncytial virus

[e]Control Nanobody raised against Toll-like receptor 3

TABLE C-43

Effect of linking Nanobodies in bivalent or biparatopic combinations on the neutralizing potency.

| | Nanobodies Stock | | | | CVS neutralizing antibody titre strain CVS-11, ATCC VR 959, sequence G protein: NCBI EU126641 50% dilution | IU[a]/ml | IU/mg | IU/nM[b] | nM IC50[c] | Potency (IU/nM) increase versus monovalent |
|---|---|---|---|---|---|---|---|---|---|---|
| Bivalent | 17/09/08 | NB6 | 18GS | NB6 | 10 | <0.50 | <2.38 | <0.07 | >725 | — |
| | 17/09/08 | 213-H7 | 15GS | 213-H7 | 12839 | 412 | 549 | 15.38 | 2.09 | 34.2 |
| | 17/09/08 | 214-E8 | 15GS | 214-E8 | 14156 | 454 | 349 | 9.78 | 3.28 | 31.5 |
| | 17/09/08 | 212-C12 | 15GS | 212-C12 | 10284 | 330 | 330 | 8.57 | 3.74 | 4.6 |
| | 25/02/09 | 213-E6 | 5GS | 213-E6 | 41075 | 1292 | 1297 | 36 | 0.88 | 27.7 |
| | 30/10/08 | 213-E6 | 25GS | 213-E6 | 674 | 21 | 300 | 8.29 | 3.76 | 6.4 |
| | 30/10/08 | 214-F8 | 15GS | 214-F8 | 421 | 13 | 650 | 17.2 | 1.79 | 63.7 |
| Biparatopic | 17/09/08 | 213-E6 | 5GS | 212-C12 | 12006 | 385 | 385 | 10 | 3.21 | 6.3 |
| | 17/09/08 | 213-E6 | 25GS | 212-C12 | 40199 | 1289 | 248 | 6.70 | 4.79 | 4.2 |
| | 30/10/08 | 213-E6 | 25GS | 214-E8 | 1489 | 46 | 657 | 1.84 | 1.68 | 2.3 |
| | 03/02/09 | 213-E6 | 15GS | 213-H7 | 125670 | 3763 | 4252 | 93.7 | 0.26 | 107.1 |
| | 17/09/08 | 214-E8 | 5GS | 212-C12 | 5340 | 171 | 214 | 5.68 | 5.65 | 5.2 |
| | 17/09/08 | 214-E8 | 15GS | 212-C12 | 31109 | 998 | 322 | 8.70 | 3.69 | 8 |
| | 30/10/08 | 214-E8 | 25GS | 212-C12 | 2767 | 70.5 | 573 | 1.60 | 1.94 | 1.5 |
| | 25/02/09 | 214-E8 | 15GS | 213-H7 | 59651 | 1890 | 8215 | 230 | 0.14 | 605.3 |
| | 25/02/09 | 213-H7 | 15GS | 214-F8 | 13532 | 429 | 3575 | 97.5 | 0.33 | 270.8 |

[a]International Unit (IU)

[b]1 mg bihead Nanobody/ml = 35.7 to 38.5 μM

[c]= mg/ml × 1/50% dilution × (35700 to 38500)

TABLE C-44

Synthesis of the peak clinical score, mortality and survival time in different groups of mice as described in Example 50

| Nr. of mice | Inoculum Virus | | Pre-incubated with | Peak clinical score[a] (mean/mouse) | Mortality (%) | Mean time for mice death (days) | Median survival time[b] (days) |
|---|---|---|---|---|---|---|---|
| 7 | $10^{1.5}TCID_{50}$[c] | — | PBS | 4.3 | 71 | 7.4 ± 0.89 | 7 |
| 7 | $10^{1.5}TCID_{50}$ | 1 IU | mab 8-2 | 0 | 0 | Na[d] | na |
| 6 | $10^{1.5}TCID_{50}$ | 6.4 μg | 191-G2 | 5.3 | 100 | 7.3 ± 0.52 | 7 |
| 7 | $10^{1.5}TCID_{50}$ | 1 IU | 212-C12 | 6 | 100 | 7.4 ± 0.53 | 7 |
| 7 | $10^{1.5}TCID_{50}$ | 1 IU | 213-E6 | 3.4 | 57 | 6.75 ± 0.96 | 9 |

[a]clinical scores range from 0 (no disease) to 6 (weight loss, depression, hunched back, wasp waist, incoordination and hind limb paralysis)

[b]the median survival time is the time at which half of the mice have died on the Kaplan Meier curve (survival curve)

[c]$TCID_{50}$: tissue culture infectious dose 50%,

[d]not applicable

TABLE C-45

Synthesis of peak clinical score, mortality and survival time in different groups of mice as described in Example 50

| Nr. of mice | Inoculum | Pre-incubated | Peak clinical score[a] (mean/mouse) | Mortality (%) | Mean time for mice death (days) | Median survival time[b] (days) |
|---|---|---|---|---|---|---|
| 8 | $10^{1.5}$ $TCID_{50}$[c] | 191-G2 1IU | 5.25 ± 2.12 | 87.5 | 7.29 ± 1.25 | 8 |
| 9 | $10^{1.5}$ $TCID_{50}$ | Mab 8-2 1IU | 0 | 0 | 0 | na[d] |
| 9 | $10^{1.5}$ $TCID_{50}$ | 212-C12 15GS 212-C12 1IU | 1.33 ± 2.65 | 22.2 | 9 ± 1.4 | na |
| 9 | $10^{1.5}$ $TCID_{50}$ | 214-E8 15GS 214-E8 1IU | 0 | 0 | 0 | na |
| 9 | $10^{1.5}$ $TCID_{50}$ | 213-H7 15GS 213-H7 1IU | 0 | 0 | 0 | na |
| 9 | $10^{1.5}$ $TCID_{50}$ | 214-E8 15GS 212-C12 1IU | 0 | 0 | 0 | na |
| 9 | $10^{1.5}$ $TCID_{50}$ | 213-E6 25GS 212-C12 1IU | 0 | 0 | 0 | na |
| 8 | $10^{1.5}$ $TCID_{50}$ | 213-E6 5GS 212-C12 1IU | 0 | 0 | 0 | na |
| 9 | $10^{1.5}$ $TCID_{50}$ | 213-E6 15GS 213-H7 1IU | 0 | 0 | 0 | na |

[a]clinical scores range from 0 (no disease) to 6 (weight loss, depression, hunched back, wasp waist, incoordination and hind limb paralysis)

[b]the median survival time is the time at which half of the mice have died on the Kaplan Meier curve (survival curve)

[c]$TCID_{50}$: tissue culture infectious dose 50%,

[d]not applicable

TABLE C-46

Synthesis of peak clinical score, mortality and survival time in different groups of mice as described in Example 52

| Nr. of mice | Antibody/Nanobody IN injection on day −1 | Virus IN injection on day 0 | Peak clinical score (mean/mouse)[a] | Mortality (%) | Mean time for mice death (days) | Median survival time (days)[b] |
|---|---|---|---|---|---|---|
| 8 | 191-D3 1IU | $10^2$ $TCID_{50}$[c] | 6.1 ± 2.5 | 87.5 | 9.9 ± 1.4 | 9 |
| 8 | Mab 8-2 1IU | $10^2$ $TCID_{50}$ | 0 | 0 | 0 | Na[d] |
| 8 | 212-C12 1IU | $10^2$ $TCID_{50}$ | 6.1 ± 2.5 | 87.5 | 10.2 ± 1.6 | 12 |
| 8 | 213-E6 1IU | $10^2$ $TCID_{50}$ | 5.25 ± 3.2 | 75 | 11.8 ± 1.6 | 12 |

[a]clinical scores range from 0 (no disease) to 7 (conjunctivitis, weight loss, depression, hunched back, wasp waist, incoordination and hind limb paralysis)
[b]the median survival time is the time at which half of the mice have died on the Kaplan Meier curve (survival curve)
[c]$TCID_{50}$: tissue culture infectious dose 50%
[d]not applicable

TABLE C-47

Synthesis of peak clinical score, mortality and survival time upon intranasal inoculation of a mix of virus and NANOBODY ® ($V_{HH}$ sequence) or antibody as described in Example 51

| Exp | Nr. of mice | Inoculum | Peak clinical score (mean/mouse)[a] | Mortality (%) | Mean time for mice death (days) | Median survival time (days)[b] |
|---|---|---|---|---|---|---|
| I | 8 | CVS $10^3$ $TCID_{50}$[c] + 191-D3 | 6.5 ± 0.53 | 100 | 8.75 ± 0.46 | 9 |
| | 9 | CVS $10^3$ $TCID_{50}$ + 212-C12 | 3.78 ± 3.6 | 55.6 | 11.6 ± 1.52 | 13 |
| | 9 | CVS $10^3$ $TCID_{50}$ + 213-E6 | 3 ± 3.57 | 44.4 | 12.5 ± 1 | na[d] |
| II | 8 | CVS $10^2$ $TCID_{50}$ + PBS | 6.12 ± 2.5 | 87.5 | 12 ± 0 | 12 |
| | 8 | CVS $10^2$ $TCID_{50}$ + Mab 8-2 | 6 ± 2.5 | 87.5 | 10.3 ± 1.6 | 10.5 |
| | 8 | CVS $10^2$ $TCID_{50}$ + 212-C12 | 0 | 0 | 0 | na |
| | 8 | CVS $10^2$ $TCID_{50}$ + 213-E6 | 0 | 0 | 0 | na |
| III | 8 | CVS $10^2$ $TCID_{50}$ + 191-D3 | 4.22 ± 3.23 | 66 | 11.3 ± 3.14 | 13 |
| | 8 | CVS $10^2$ $TCID_{50}$ + Mab8-2 | 6.11 ± 2.3 | 89 | 9.25 ± 0.46 | 9 |
| | 8 | CVS $10^2$ $TCID_{50}$ + 212-C12 | 2.33 ± 3.5 | 33 | 11.7 ± 2.3 | na |
| | 8 | CVS $10^2$ $TCID_{50}$ + 213-E6 | 0 | 0 | 0 | na |
| | 8 | CVS $10^2$ $TCID_{50}$ + 214E8-15GS-213-H7 | 0 | 0 | 0 | na |

[a]clinical scores range from 0 (no disease) to 6 (weight loss, depression, hunched back, wasp waist, incoordination and hind limb paralysis),
[b]the median survival time is the time at which half of the mice have died on the Kaplan Meier curve (survival curve),
[c]$TCID_{50}$: tissue culture infectious dose 50%,
[d]not applicable

TABLE C-48

Synthesis of peak clinical score, mortality and survival time in different groups of mice as described in Example 50.2

| Nr. of mice | Inoculum | Pre-incubated | Peak clinical score[b] (mean/mouse) | Mortality (%) | Mean time for mice death (days) | Median survival time[c] (days) |
|---|---|---|---|---|---|---|
| 9 | $10^{1.5}$ $TCID_{50}$[d] | NB6-18GS-NB6 1IU | 5.33 ± 2 | 88.9 | 7.12 ± 2.42 | 6 |
| 9 | $10^{1.5}$ $TCID_{50}$ | Mab 8-2 1IU | 0 | 0 | 0 | na[e] |
| 10 | $10^{1.5}$ $TCID_{50}$ | 214-E8 15GS 212-C12 | 0 | 0 | 0 | na |
| 9 | $10^{1.5}$ $TCID_{50}$ | 213-E6 25GS 212-C12 1IU | 0 | 0 | 0 | na |
| 7 | $10^{1.5}$ $TCID_{50}$ | 213-E6 5GS 212-C12 1IU | 0.86 ± 2.27 | 14.3 | 21 | na |
| 9 | $10^{1.5}$ $TCID_{50}$ | 213-E6 15GS 213-H7 1IU | 0 | 0 | 0 | na |
| 10 | $10^{1.5}$ $TCID_{50}$ | 213-E6 5GS 213-E6 1IU | 0 | 0 | 0 | na |
| 9 | $10^{1.5}$ $TCID_{50}$ | 213-E6 15GS 214-E8 1IU | 4 ± 3 | 66.7 | 12.5 ± 1.22 | 13 |
| 10 | $10^{1.5}$ $TCID_{50}$ | 214-E8 15GS 213-E6 1IU | 0 | 0 | 0 | na |

[b]clinical scores range from 0 (no disease) to 6 (weight loss, depression, hunched back, wasp waist, incoordination and hind limb paralysis)
[c]the median survival time is the time at which half of the mice have died on the Kaplan Meier curve (survival curve)
[d]$TCID_{50}$: tissue culture infectious dose 50%,
[e]not applicable

TABLE C-49

Synthesis of peak clinical score, mortality and survival time in different groups of mice as described in Example 50.4

| Nr. of mice | Inoculum | Pre-incubated | Peak clinical score[a] (mean/mouse) | Mortality (%) | Mean time for mice death (days) | Median survival time (days) |
|---|---|---|---|---|---|---|
| 9 | $10^2$ $TCID_{50}$[c] | PBS | 6 ± 0 | 100 | 6.11 ± 0.33 | 6 |
| 8 | $10^2$ $TCID_{50}$ | RV1C5 1 IU | 0 | 0 | 0 | na[d] |
| 9 | $10^2$ $TCID_{50}$ | 213E6-15GS-213H7 1 IU | 0 | 0 | 0 | na |

[a]clinical scores range from 0 (no disease) to 6 (weight loss, depression, hunched back, wasp waist, incoordination and hind limb paralysis)
[b]the median survival time is the time at which half of the mice have died on the Kaplan Meier curve (survival curve)
[c]$TCID_{50}$: Tissue Culture Infectious Dose 50%,
[d]not applicable

TABLE C-50

Synthesis of peak clinical score, mortality and survival time upon intranasal or intracerebral inoculation of $10^2$ $TCID_{50}$ CVS-11 mixed with 1 IU 212-C12.

| Nr. of mice | Inoculum | Pre-incubated | Route of inoculation | Peak clinical score[a] (mean/mouse) | Mortality (%) | Mean time for mice death (days) | Median survival time[b] (days) |
|---|---|---|---|---|---|---|---|
| 9 | $10^2$ $TCID_{50}$[c] | 212-C12 1IU | IC | 6 ± 0 | 100 | 7.22 ± 0.44 | 7 |
| 9 | $10^2$ $TCID_{50}$ | 212-C12 1IU | IN | 0 | 0 | 0 | na[d] |

[a]clinical scores range from 0 (no disease) to 6 (weight loss, depression, hunched back, wasp waist, incoordination and hind limb paralysis)
[b]the median survival time is the time at which half of the mice have died on the Kaplan Meier curve (survival curve)
[c]$TCID_{50}$: tissue culture infectious dose 50%
[d]not applicable

TABLE C-51

Concentration (ng) of NANOBODY ® ($V_{HH}$ sequence) RSV101 or 12B2biv in lung homogenatesof mice inoculated with NANOBODY ® ($V_{HH}$ sequence) 3 and 5 days after administering of the NANOBODY ® ($V_{HH}$ sequence) and infection with RSV as described in Example 55.

| | Day 3 | | | Day 5 | | |
|---|---|---|---|---|---|---|
| Mouse | RSV101 | 12B2biv | PBS | RSV101 | 12B2biv | PBS |
| 1 | 17.47 | 36.42 | <5 | 5.8 | 19.15 | 6.68 |
| 2 | 14.21 | 27.07 | 8.46 | <5 | 10.21 | |
| 3 | 29.69 | 15.92 | | <5 | 16.56 | |

TABLE C-51-continued

Concentration (ng) of NANOBODY ® ($V_{HH}$ sequence) RSV101 or 12B2biv in lung homogenatesof mice inoculated with NANOBODY ® ($V_{HH}$ sequence) 3 and 5 days after administering of the NANOBODY ® ($V_{HH}$ sequence) and infection with RSV as described in Example 55.

| | Day 3 | | | Day 5 | | |
|---|---|---|---|---|---|---|
| Mouse | RSV101 | 12B2biv | PBS | RSV101 | 12B2biv | PBS |
| 4 | 31.69 | 45.74 | | <5 | 14.86 | |
| 5 | 19.55 | 27.59 | | <5 | 21.51 | |

TABLE C-52

Neutralization and kinetic binding parameters for selected NC41 variants

| | Neutralization IC50 (nM) | | | | Biacore ($F_{m}$-NN) | | |
|---|---|---|---|---|---|---|---|
| Name | Long | B-1 | Long | B-1 | ka (1/Ms) | kd (1/s) | KD (M) |
| NC41 | 202 | 4707 | 122 | 3291 | 1.7E+06 | 6.70E−03 | 4.00E−09 |
| NC41v03 | 255 | 1507 | nd | nd | nd | nd | nd |
| NC41v06 | 111 | 806 | nd | nd | 2.0E+06 | 4.80E−03 | 2.50E−09 |
| NC41v17 | 249 | 677 | 149 | 346 | 1.9E+06 | 5.90E−03 | 3.20E−09 |
| NC41v18 | 116 | 728 | 98 | 194 | nd | nd | nd |
| Synagis | 7.3 | 2.1 | 6.0 | 2.9 | | | |

TABLE C-53

Antigens used for llama immunization

| Virus strain | Serotype | Amount[a] (μg) |
|---|---|---|
| Llama 3049 | | |
| A/Chicken/Italy/1067/1999 | H7N1 | 100 |
| A/Mallard/Netherlands/2/2005 | H5N2 | 100 |
| A/Swan/Netherlands/06003448/2006 | H7N7 | 100 |
| FMDV Asia 1 Shamir | Asia 1 | 50 |
| FMDV A24 Cruzeiro | A | 15 |
| Llama 3050 | | |
| A/Ostrich/Netherlands/03006814/2003 | H2N3 | 100 |
| A/Mallard/Netherlands/06026212/2006 | H8N4 | 100 |
| A/Ty/Netherlands/06001571-041Tr/2006 | H6N5 | 100 |
| A/Chearwater/Australia/2576/02 | H15N6 | 100 |
| A/Mallard/Netherlands/06014516/2006 | H10N8 | 100 |
| A/Chicken/Italy/22A/98 | H5N9 | 100 |
| FMDV SAT2 | SAT2 | 50 |

[a] Amount of antigen for each individual immunization.

TABLE C-54

Analysis of llama antibody response by haemagglutination inhibition test

| | Immunised with | H7N1 HI titer 2log | | | H5N7 HI titer 2log | | |
|---|---|---|---|---|---|---|---|
| llama | H5 and H7 strains | 0 DPI | 34 DPI | 55 DPI | 0 DPI | 34 DPI | 55 DPI |
| 3049 | H7N1/H5N2/H7N7 | — | 7 | 9 | — | 3 | 5 |
| 3050 | H5N9 | — | — | — | — | 7 | 11 |

TABLE C-55

Oligonucleotides used for the construction of phage display libraries and sequencing as described in example 61

| Primer | SEQ ID NO: | Sequence (5'-3') |
|---|---|---|
| NotI-d(T)18 | 3057 | AACTGGAAGAATTCGCGGCCGCAGGAA TTTTTTTTTTTTTTTTTT |
| VH2B | 3058 | AGGTSMARCTGCAGSAGTCWGG |
| lam07 | 3059 | AACAGTTAAGCTTCCGCTTGCGGCCGCGGAG CTGGGGTCTTCGCTGTGGTGCG |
| lam08 | 3060 | AACAGTTAAGCTTCCGCTTGCGGCCGCTGGTT GTGGTTTTGGTGTCTTGGGTT |

TABLE C-55-continued

Oligonucleotides used for the construction of phage display libraries and sequencing as described in example 61

| Primer | SEQ ID NO: | Sequence (5'-3') |
|---|---|---|
| BOLI-192 | 3061 | AACAGTTAAGCTTCCGCTTGCGGCCGCTA CTTCATTCGTTCCTGAGGAGACGGT |
| MPE26 | 3062 | GGATAACAATTTCACACAGGA |

TABLE C-56

Phage display libraries obtained as described in Example 61

| Library | Llama | Days post immunisation | Hinge primer | Library Size[a] |
|---|---|---|---|---|
| pAL439 | 3049 | 34 | lam07 | $4.7 \times 10^6$ |
| pAL440 | 3049 | 34 | lam08 | $8.0 \times 10^6$ |
| pAL441 | 3049 | 34 | BOLI-192 | $6.1 \times 10^6$ |
| pAL442 | 3049 | 55 | lam07 | $6.7 \times 10^6$ |
| pAL443 | 3049 | 55 | lam08 | $7.6 \times 10^6$ |
| pAL444 | 3049 | 55 | BOLI-192 | $1.1 \times 10^7$ |
| pAL445 | 3050 | 34 | lam07 | $1.0 \times 10^7$ |
| pAL446 | 3050 | 34 | lam08 | $9.8 \times 10^6$ |
| pAL447 | 3050 | 34 | BOLI-192 | $8.0 \times 10^6$ |
| pAL448 | 3050 | 55 | lam07 | $5.4 \times 10^6$ |
| pAL449 | 3050 | 55 | lam08 | $9.5 \times 10^6$ |
| pAL450 | 3050 | 55 | BOLI-192 | $5.3 \times 10^6$ |

[a] The number of colonies obtained after transformation of *E. coli* TG1.

TABLE C-57

Influenza strains used for antigen preparation as described in Example 63

| Influenza strain | Serotype |
|---|---|
| A/PR/8/34 (ATCC VR-1469) | H1N1 |
| A/Mallard/Netherlands/2/05 | H5N2 |
| A/Mallard/Denmark/75-64650/03 | H5N7 |
| A/Turkey/Wisconsin/68 | H5N9 |
| A/Chicken/Italy/1067/V99 | H7N1 |
| A/Swan/Netherlands/06003448/06 | H7N7 |
| A/Ostrich/Netherlands/03006814/03 | H2N3 |
| A/Ty/Netherlands/06001571-041Tr/06 | H6N5 |
| A/Mallard/Netherlands/06026212-002/06 | H8N4 |
| A/Duck/Germany/R113/95 | H9N2 |
| A/Mallard/Netherlands/06014516/06 | H10N8 |
| A/Chearwater/Australia/2576/02 | H15N6 |

TABLE C-58

Sequence characteristics, panning history and binding to influenza antigens of selected putative H5 binding NANOBODIES ® ($V_{HH}$ sequences)

| Clone | Number of identical clones[a] | CDR3 Group[b] | Potential N-glycosylation site[c] | BstEII site in FR4[d] | Panning round 1 on antigen[e] | Panning round 2 on antigen[e] | Extinction at 450 nm in ELISA on AIV antigens[e] H1N1 | H7N7 | H5N2 | H5N9 | H5N7 | Expressed in yeast |
|---|---|---|---|---|---|---|---|---|---|---|---|---|
| IV121 | 3 | A | None | present | H5N2 | HAhis6 H5N1 | 0.085 | 0.053 | 0.101 | 0.099 | 0.449 | not done |
| IV122 | 2 | A | None | present | H5N2 | HAhis6 H5N1 | 0.06 | 0.055 | 0.168 | 0.129 | 0.937 | not done |
| IV123 | 1 | A | None | present | H5N2 | HAhis6 H5N1 | 0.065 | 0.06 | 0.12 | 0.188 | 0.487 | not done |
| IV126 | 1 | A | None | present | H5N2 | HAhis6 H5N1 | 0.142 | 0.06 | 0.202 | 0.33 | 0.883 | not done |
| IV127 | 2 | A | None | present | H5N2 | HAhis6 H5N1 | 0.113 | 0.106 | 0.216 | 0.443 | 1.15 | not done |
| IV131 | 1 | A | None | present | H5N2 | HAhis6 H5N1 | 0.047 | 0.046 | 0.216 | 0.398 | 0.936 | done |
| IV132 | 1 | A | None | present | H5N2 | HAhis6 H5N1 | 0.048 | 0.048 | 0.072 | 0.113 | 0.33 | not done |
| IV133 | 1 | A | None | present | H5N2 | HAhis6 H5N1 | 0.048 | 0.051 | 0.243 | 0.377 | 1.206 | done |
| IV134 | 2 | A | None | present | H5N2 | HAhis6 H5N1 | 0.049 | 0.049 | 0.106 | 0.194 | 0.95 | not done |
| IV135 | 1 | A | None | present | H5N2 | HAhis6 H5N1 | 0.053 | 0.049 | 0.195 | 0.169 | 0.832 | not done |
| IV136 | 1 | A | None | present | H5N2 | HAhis6 H5N1 | 0.088 | 0.123 | 0.182 | 0.372 | 0.953 | not done |
| IV140 | 3 | A | None | present | H5N2 | HAhis6 H5N1 | 0.047 | 0.048 | 0.117 | 0.099 | 0.834 | not done |
| IV144 | 3 | A | None | present | H5N2 | HAhis6 H5N1 | 0.12 | 0.089 | 0.407 | 0.656 | 1.282 | done |
| IV156 | 1 | A | None | present | H5N9 | H5N7 | 0.048 | 0.054 | 0.401 | 0.649 | 1.418 | done |
| IV157 | 1 | A | None | present | H5N9 | H5N7 | 0.046 | 0.049 | 0.352 | 0.336 | 1.375 | done |
| IV160 | 1 | A | None | present | H5N9 | HAhis6 H5N1 | 0.052 | 0.053 | 0.283 | 0.312 | 1.243 | not done |
| IV124 | 2 | B | None | present | H5N2 | HAhis6 H5N1 | 0.413 | 0.063 | 0.274 | 0.429 | 0.868 | not done |
| IV125 | 1 | B | None | present | H5N2 | HAhis6 H5N1 | 0.461 | 0.076 | 0.272 | 0.413 | 0.801 | not done |
| IV145 | 1 | B | None | present | H5N2 | HAhis6 H5N1 | 0.204 | 0.056 | 0.162 | 0.183 | 0.746 | not done |
| IV146 | 1 | B | None | present | H5N2 | HAhis6 H5N1 | 0.299 | 0.051 | 0.223 | 0.285 | 0.744 | done |
| IV147 | 5 | B | None | present | H5N2 | HAhis6 H5N1 | 0.216 | 0.047 | 0.182 | 0.197 | 0.599 | not done |
| IV151 | 1 | C | None | absent | H5N2 | HAhis6 H5N1 | 0.172 | 0.106 | 0.164 | 0.181 | 0.709 | not done |
| IV153 | 1 | D | None | absent | H5N7 | H5N2 | 0.045 | 0.048 | 0.436 | 0.05 | 0.056 | not done |
| IV154 | 1 | E | None | present | H5N9 | H5N2 | 0.843 | 0.961 | 1.594 | 0.566 | 1.35 | done |
| IV155 | 1 | F | None | present | H5N9 | H5N2 | 0.759 | 1.059 | 1.641 | 0.449 | 1.243 | done |

[a]Number of times a clone was isolated that encodes an identical Nanobody.
[b]Clones belonging to the same CDR3 group have highly similar CDR3 sequences and identical CDR3 length.
[c]Potential N-glycosylation sites (Asn-X-Ser/Thr, where X is not Pro) are either absent or present at the indicated position (IMGT numbering).
[d]The presence of a unique BstEII restriction endonuclease cleavage site present in the FR4 encoding region and suitable for subcloning into yeast expression vector pRL188 is indicated.
[e]H1N1, H7N7, H5N2, H5N7 and H5N9 refer to authentic influenza antigen produced by MDCK cells; HAhis6 H5N1 was from Abcam (cat. No. ab53938).

TABLE C-59

Sequence characteristics, panning history and binding to influenza antigens of selected putative H7 binding NANOBODIES ® ($V_{HH}$ sequences)

| Clone | Number of identical clones[a] | CDR3 Group[b] | Potential N-glycosylation site[c] | BstEII site in FR4[d] | Panning round 1 on antigen[e] | Panning round 2 on antigen[e] | Extinction at 450 nm in ELISA on AIV antigens[e] H1N1 | H5N2 | H5N7 | H5N9 | H7N1 | H7N7 | Expressed in yeast |
|---|---|---|---|---|---|---|---|---|---|---|---|---|---|
| IV1 | 1 | A | None | present | H7N1 or H7N7 | HAstr H7N2 | 0.056 | 0.051 | 0.057 | 0.052 | 1.277 | 1.096 | done |
| IV2 | 1 | A | 84 | present | H7N1 or H7N7 | HAstr H7N2 | 0.048 | 0.05 | 0.048 | 0.045 | 1.366 | 0.814 | not done |
| IV3 | 1 | A | 84 | present | H7N1 or H7N7 | HAstr H7N2 | 0.048 | 0.049 | 0.048 | 0.047 | 1.161 | 0.832 | not done |
| IV4 | 1 | A | 84 | present | H7N1 or H7N7 | HAstr H7N2 | 0.047 | 0.05 | 0.048 | 0.047 | 1.158 | 0.945 | not done |
| IV6 | 2 | A | 84 | present | H7N1 or H7N7 | HAstr H7N2 | 0.048 | 0.051 | 0.05 | 0.054 | 0.92 | 0.724 | not done |
| IV7 | 1 | A | 84 | present | H7N1 or H7N7 | HAstr H7N2 | 0.048 | 0.054 | 0.05 | 0.047 | 1.2 | 0.806 | not done |
| IV9 | 1 | A | 84 | present | H7N1 or H7N7 | HAstr H7N2 | 0.046 | 0.051 | 0.047 | 0.047 | 1.008 | 0.939 | not done |
| IV10 | 1 | A | 84 | present | H7N1 or H7N7 | HAstr H7N2 | 0.047 | 0.052 | 0.047 | 0.048 | 1.133 | 1.078 | not done |
| IV11 | 1 | A | 84 | present | H7N1 or H7N7 | HAstr H7N2 | 0.047 | 0.05 | 0.053 | 0.051 | 0.912 | 0.762 | not done |
| IV12 | 1 | A | 84 | present | H7N1 or H7N7 | HAstr H7N2 | 0.065 | 0.123 | 0.195 | 0.078 | 0.956 | 0.984 | not done |
| IV16 | 1 | A | 84 | present | H7N1 | HA1his H7N7 | 0.048 | 0.05 | 0.05 | 0.045 | 1.071 | 0.789 | not done |
| IV24 | 1 | A | 84 | present | H7N7 | HA1his H7N7 | 0.05 | 0.049 | 0.051 | 0.047 | 1.166 | 1.032 | not done |
| IV26 | 1 | A | 84 | present | H7N7 | HA1his H7N7 | 0.061 | 0.109 | 0.114 | 0.097 | 1.127 | 1.003 | done |
| IV30 | 1 | A | 84 | present | H7N1 | HA1his H7N7 | 0.054 | 0.054 | 0.072 | 0.053 | 0.844 | 0.32 | not done |
| IV34 | 1 | A | 84 | present | H7N1 | HA1his H7N7 | 0.05 | 0.108 | 0.076 | 0.079 | 1.097 | 0.95 | not done |
| IV14 | 1 | B | None | present | H7N1 | HA1his H7N7 | 0.054 | 0.05 | 0.052 | 0.048 | 1.191 | 0.969 | not done |
| IV15 | 1 | B | None | present | H7N1 | HA1his H7N7 | 0.046 | 0.05 | 0.053 | 0.05 | 0.551 | 0.502 | not done |
| IV17 | 7 | B | None | present | H7N1 | HA1his H7N7 | 0.046 | 0.05 | 0.048 | 0.046 | 0.67 | 0.593 | not done |
| IV18 | 3 | B | None | present | H7N1 | HA1his H7N7 | 0.051 | 1.503 | 0.516 | 0.098 | 0.927 | 0.608 | not done |
| IV29 | 1 | B | None | present | H7N1 | HA1his H7N7 | 0.053 | 0.049 | 0.054 | 0.048 | 0.946 | 1.002 | done |
| IV31 | 1 | B | None | present | H7N1 | HA1his H7N7 | 0.045 | 0.051 | 0.05 | 0.049 | 1.013 | 1.043 | not done |
| IV33 | 1 | B | None | present | H7N1 | HA1his H7N7 | 0.045 | 0.049 | 0.047 | 0.047 | 0.885 | 0.762 | not done |
| IV35 | 1 | B | None | present | H7N7 | HA1his H7N7 | 0.065 | 0.054 | 0.054 | 0.047 | 1.121 | 0.907 | not done |
| IV36 | 1 | B | None | present | H7N7 | HA1his H7N7 | 0.048 | 0.048 | 0.048 | 0.047 | 1.029 | 0.999 | not done |
| IV40 | 1 | B | None | absent | H7N7 | HA1his H7N7 | 0.048 | 0.05 | 0.05 | 0.047 | 1.021 | 0.667 | not done |
| IV42 | 1 | B | None | present | H7N1 | HA1his H7N7 | 0.06 | 0.049 | 0.052 | 0.048 | 0.741 | 0.797 | not done |

TABLE C-59-continued

Sequence characteristics, panning history and binding to influenza antigens of selected putative H7 binding NANOBODIES ® ($V_{HH}$ sequences)

| Clone | Number of identical clones[a] | CDR3 Group[b] | Potential N-glycosylation site[c] | BstEII site in FR4[d] | Panning round 1 on antigen[e] | Panning round 2 on antigen[e] | Extinction at 450 nm in ELISA on AIV antigens[e] H1N1 | H1N1 | H1N1 | H1N1 | H1N1 | H1N1 | Expressed in yeast |
|---|---|---|---|---|---|---|---|---|---|---|---|---|---|
| IV8 | 1 | C | None | present | H7N1 or H7N7 | HAstr H7N2 | 0.047 | 0.05 | 0.049 | 0.045 | 1.077 | 0.456 | not done |
| IV21 | 1 | C | None | present | H7N7 | HA1his H7N7 | 0.047 | 0.047 | 0.047 | 0.05 | 0.945 | 0.565 | done |
| IV23 | 1 | C | None | present | H7N7 | HA1his H7N7 | 0.047 | 0.048 | 0.049 | 0.046 | 1.052 | 0.616 | not done |
| IV45 | 1 | C | None | present | H7N1 | HA1his H7N7 | 0.05 | 0.052 | 0.05 | 0.047 | 0.59 | 0.217 | not done |
| IV47 | 1 | C | None | present | H7N7 | HA1his H7N7 | 0.07 | 0.055 | 0.054 | 0.05 | 1.077 | 0.668 | not done |
| IV48 | 1 | C | None | present | H7N7 | HA1his H7N7 | 0.061 | 0.051 | 0.052 | 0.048 | 0.939 | 0.442 | not done |
| IV50 | 1 | C | None | present | H7N7 | HA1his H7N7 | 0.056 | 0.055 | 0.052 | 0.049 | 0.814 | 0.32 | not done |
| IV22 | 2 | D | None | present | H7N7 | HA1his H7N7 | 0.051 | 0.05 | 0.051 | 0.053 | 1.001 | 0.976 | not done |
| IV37 | 1 | D | None | present | H7N7 | HA1his H7N7 | 0.048 | 0.049 | 0.05 | 0.048 | 1.001 | 0.978 | done |
| IV38 | 1 | D | None | present | H7N7 | HA1his H7N7 | 0.047 | 0.051 | 0.05 | 0.047 | 0.915 | 0.99 | not done |
| IV5 | 1 | E | None | present | H7N1 or H7N7 | HAstr H7N2 | 0.054 | 0.049 | 0.05 | 0.049 | 1.171 | 1.092 | done |
| IV27 | 1 | E | None | present | H7N1 | HA1his H7N7 | 0.054 | 0.047 | 0.051 | 0.048 | 1.321 | 1.165 | not done |
| IV25 | 1 | F | None | present | H7N7 | HA1his H7N7 | 0.046 | 0.05 | 0.048 | 0.047 | 0.706 | 0.797 | done |
| IV28 | 1 | G | None | present | H7N1 | HA1his H7N7 | 0.049 | 0.049 | 0.049 | 0.047 | 0.704 | 0.714 | failed |

[a]Number of times a clone was isolated that encodes an identical Nanobody.
[b]Clones belonging to the same CDR3 group have highly similar CDR3 sequences and identical CDR3 length.
[c]Potential N-glycosylation sites (Asn-X-Ser/Thr, where X is not Pro) are either absent or present at the indicated position (IMGT numbering).
[d]The presence of a unique BstEII restriction endonuclease cleavage site present in the FR4 encoding region and suitable for subcloning into yeast expression vector pRL188 is indicated.
[e]H1N1, H7N1, H7N7, H5N2, H5N7 and H5N9 refer to authentic influenza antigen produced by MDCK cells; HA1his H7N7 was from Abcam (Abcam, Cat. No. ab61286).

TABLE C-60

Antigen binding characteristics of yeast-produced NANOBODIES ® ($V_{HH}$ sequences) binding to H5 strains

| Clone | CDR3 group | ELISA titers[c] (ng/ml) H5N9[a] | HA0his6 H5, ab53938[b] | HA1his6 H7, ab53875[b] | VNT titer[d] (ug/ml) H5N7 | H5N9 | HI titer[e] (ug/ml) H5N7 | H5N9 |
|---|---|---|---|---|---|---|---|---|
| IV131 | A | 19.5 | 36.8 | 32 | >50 | >50 | >1000 | >1000 |
| IV133 | A | 29.4 | 39.1 | 32.5 | >50 | >50 | >1000 | >1000 |
| IV144 | A | 31.6 | 33.1 | 34.8 | >50 | >50 | >1000 | >1000 |
| IV156 | A | 14.4 | 51.9 | 33 | >50 | >50 | >1000 | >1000 |
| IV157 | A | 14.5 | 30.6 | 9.9 | >50 | >50 | >1000 | >1000 |
| IV146 | B | 43.0 | 161.5 | 62.9 | <0.75 | <0.75 | >1000 | >1000 |
| IV154 | E | 8.3 | >10000 | >10000 | >50 | >50 | >1000 | >1000 |
| IV155 | F | 34.3 | >10000 | >10000 | >50 | >50 | >1000 | >1000 |

[a]ELISA titers were determined on authentic AIV antigens of strains shown in Table C-57 using a peroxidase-conjugated anti-his6 monoclonal antibody. Nanobody concentrations resulting in an extinction of 0.2 were interpolated.
[b]ELISA titers were determined on recombinant haemagglutinins derived from two different H5 influenza strains derived from Abcam. Nanobody concentrations resulting in an extinction of 1 were interpolated.
[c]>10000 indicates extinctions below the value used for interpolation of titer at the highest Nanobody concentration analysed.
[d]>50, no virus neutralization at the highest Nanobody concentration analysed; <0.75, neutralization at the lowest Nanobody concentration analysed.
[e]>1000, no inhibition of haemagglutination at the highest Nanobody concentration analysed.

TABLE C-61

Antigen binding characteristics of yeast-produced NANOBODIES ® ($V_{HH}$ sequences) binding to H7 strains

| Clone | CDR3 group | ELISA titers (ng/ml) H7N1[a] | H7N7[a] | HA1his6 H7, ab61286[b] | VNT titer[c] (μg/ml) H7N1 | H7N7 | HI titer[d] (μg/ml) H7N1 | H7N7 |
|---|---|---|---|---|---|---|---|---|
| IV1 | A | 11.2 | 66.4 | 62.2 | >50 | >50 | >600 | >600 |
| IV26 | A | 14.1 | 147 | 80.6 | >50 | >50 | >1000 | >1000 |
| IV29 | B | 6.8 | 9.3 | 7.2 | >50 | >50 | >1000 | >1000 |
| IV21 | C | 85.8 | 1969 | 69 | >50 | >50 | >1000 | >1000 |
| IV37 | D | 46 | 141 | 31.4 | >50 | >50 | >1000 | >1000 |

TABLE C-61-continued

Antigen binding characteristics of yeast-produced NANOBODIES ® ($V_{HH}$ sequences) binding to H7 strains

| | | ELISA titers (ng/ml) | | | VNT titer[c] (μg/ml) | | HI titer[d] (μg/ml) | |
|---|---|---|---|---|---|---|---|---|
| Clone | CDR3 group | H7N1[a] | H7N7[a] | HA1his6 H7, ab61286[b] | H7N1 | H7N7 | H7N1 | H7N7 |
| IV5 | E | 5.0 | 12.9 | 30.7 | >50 | >50 | >1000 | >1000 |
| IV25 | F | 18.8 | 22.8 | 27.8 | >50 | >50 | >400 | >400 |

[a]ELISA titers were determined on authentic AIV antigens of strains shown in Table C-57 using a peroxidase-conjugated anti-his6 monoclonal antibody. Nanobody concentrations resulting in an extinction of 0.2 were interpolated.
[b]ELISA titers were determined on recombinant haemagglutinin derived from Abcam (Cat. No. ab61286). Nanobody concentrations resulting in an extinction of 1 were interpolated.
[c]>50, no virus neutralization at the highest Nanobody concentration analysed.
[d]>1000, >600 or >400, no inhibition of haemagglutination at the highest Nanobody concentration analysed.

The terms and expressions which have been employed are used as terms of description and not of limitation, and there is no intention in the use of such terms and expressions of excluding any equivalents of the features shown and described or portions thereof, it being recognized that various modifications are possible within the scope of the invention.

All references disclosed herein are incorporated by reference, in particular for the teaching that is referenced hereinabove.

SEQUENCE LISTING (3591 sequences)

SEQ ID NO: 1 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
EVQLVESGGGLVQPGGSLRLSCAASGIPFSXXXXXWFRQAPGKQRDSVAXXXXXRFTISRDNAKNTVYLQMNSLKPEDTAVYRCYFXXXXXWGQGTQVTVSS

SEQ ID NO: 2 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
QVKLEESGGGLVQAGGSLRLSCVGSGRTFSXXXXXWFRLAPGKEREFVAXXXXXRFTISRDTASNRGYLHMNNLTPEDTAVYYCAAXXXXXWGQGTQVTVSS

SEQ ID NO: 3 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
AVQLVDSGGGLVQAGDSLKLSCALTGGAFTXXXXXWFRQTPGREREFVAXXXXXRFTISRDNAKNMVYLRMNSLIPEDAAVYSCAAXXXXXWGQGTLVTVSS

SEQ ID NO: 4 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
QVQLVESGGGLVEAGGSLRLSCTASESPFRXXXXXWFRQTSGQEREFVAXXXXXRFTISRDDAKNTVWLHGSTLKPEDTAVYYCAAXXXXXWGQGTQVTVSS

SEQ ID NO: 5 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
AVQLVESGGGLVQGGGSLRLACAASERIFDXXXXXWYRQGPGNERELVAXXXXXRFTISMDYTKQTVYLHMNSLRPEDTGLYYCKIXXXXXWGQGTQVTVSS

SEQ ID NO: 6 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
DVKFVESGGGLVQAGGSLRLSCVASGFNFDXXXXXWFRQAPGKEREEVAXXXXXRFTISSEKDKNSVYLQMNSLKPEDTALYICAGXXXXXWGRGTQVTVSS

SEQ ID NO: 7 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
QVRLAESGGGLVQSGGSLRLSCVASGSTYTXXXXXWYRQYPGKQRALVAXXXXXRFTIARDSTKDTFCLQMNNLKPEDTAVYYCYAXXXXXWGQGTQVTVSS

SEQ ID NO: 8 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
EVQLVESGGGLVQAGGSLRLSCAASGFTSDXXXXXWFRQAPGKPREGVSXXXXXRFTISTDNAKNTVHLLMNRVNAEDTALYYCAVXXXXXWGRGTRVTVSS

SEQ ID NO: 9 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
QVQLVESGGGLVQPGGSLRLSCQASGDISTXXXXXWYRQVPGKLREFVAXXXXXRFTISGDNAKRAIYLQMNNLKPDDTAVYYCNRXXXXXWGQGTQVTVSP

SEQ ID NO: 10 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
QVPVVESGGGLVQAGDSLRLFCAVPSFTSTXXXXXWFRQAPGKEREFVAXXXXXRFTISRNATKNTLTLRMDSLKPEDTAVYYCAAXXXXXWGQGTQVTVSS

SEQ ID NO: 11 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
EVQLVESGGGLVQAGDSLRLFCTVSGGTASXXXXXWFRQAPGEKREFVAXXXXXRFTIARENAGNMVYLQMNNLKPDDTALYTCAAXXXXXWGRGTQVTVSS

SEQ ID NO: 12 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
AVQLVESGGDSVQPGDSQTLSCAASGRTNSXXXXXWFRQAPGKERVFLAXXXXXRFTISRDSAKNMMYLQMNNLKPQDTAVYYCAAXXXXXWGQGTQVTVSS

SEQ ID NO: 13 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
AVQLVESGGGLVQAGGSLRLSCVVSGLTSSXXXXXWFRQTPWQERDFVAXXXXXRFTISRDNYKDTVLLEMNFLKPEDTAIYYCAAXXXXXWGQGTQVTVSS

SEQ ID NO: 14 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
AVQLVESGGGLVQAGASLRLSCATSTRTLDXXXXXWFRQAPGRDREFVAXXXXXRFTVSRDSAENTVALQMNSLKPEDTAVYYCAAXXXXXWGQGTRVTVSS

SEQ ID NO: 15 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
QVQLVESGGGLVQPGGSLRLSCTVSRLTAHXXXXXWFRQAPGKEREAVSXXXXXRFTISRDYAGNTAFLQMDSLKPEDTGVYYCATXXXXXWGQGTQVTVSS

SEQ ID NO: 16 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
EVQLVESGGELVQAGGSLKLSCTASGRNFVXXXXXWFRRAPGKEREFVAXXXXXRFTVSRDNGKNTAYLRMNSLKPEDTADYYCAVXXXXXLGSGTQVTVSS

SEQ ID NO: 17 - protein, 102 aa, Artificial
  GLEW-class Nanobody
  misc_feature (31)..(35): Xaa is any amino acid
  misc_feature (50)..(54): Xaa is any amino acid
  misc_feature (87)..(91): Xaa is any amino acid
AVQLVESGGGLVQPGGSLRLSCAASGFTFSXXXXXWVRQAPGKVLEWVSXXXXXRFTISRDNAKNTLYLQMNSLKPEDTAVYYCVKXXXXXGSQGTQVTVSS

SEQ ID NO: 18 - protein, 102 aa, Artificial
  GLEW-class Nanobody
  misc_feature (31)..(35): Xaa is any amino acid
  misc_feature (50)..(54): Xaa is any amino acid
  misc_feature (87)..(91): Xaa is any amino acid
EVQLVESGGGLVQPGGSLRLSCVCVSSGCTXXXXXWVRQAPGKAEEWVSXXXXXRFKISRDNAKKTLYLQMNSLGPEDTAMYYCQRXXXXXRGQGTQVTVSS

SEQ ID NO: 19 - protein, 102 aa, Artificial
  GLEW-class Nanobody
  misc_feature (31)..(35): Xaa is any amino acid
  misc_feature (50)..(54): Xaa is any amino acid
  misc_feature (87)..(91): Xaa is any amino acid
EVQLVESGGGLALPGGSLTLSCVFSGSTFSXXXXXWVRHTPGKAEEWVSXXXXXRFTISRDNAKNTLYLEMNSLSPEDTAMYYCGRXXXXXRSKGIQVTVSS

SEQ ID NO: 20 - protein, 102 aa, Artificial
  P,R,S 103-class Nanobody
  misc_feature (31)..(35): Xaa is any amino acid
  misc_feature (50)..(54): Xaa is any amino acid
  misc_feature (87)..(91): Xaa is any amino acid
AVQLVESGGGLVQAGGSLRLSCAASGRTFSXXXXXWFRQAPGKEREFVAXXXXXRFTISRDNAKNTVYLQMNSLKPEDTAVYYCAAXXXXXRGQGTQVTVSS

SEQ ID NO: 21 - protein, 102 aa, Artificial
  P,R,S 103-class Nanobody
  misc_feature (31)..(35): Xaa is any amino acid
  misc_feature (50)..(54): Xaa is any amino acid
  misc_feature (87)..(91): Xaa is any amino acid
DVQLVESGGDLVQPGGSLRLSCAASGFSFDXXXXXWLRQTPGKGLEWVGXXXXXRFTISRDNAKNMLYLHLNNLKSEDTAVYYCRRXXXXXLGQGTQVTVSS

SEQ ID NO: 22 - protein, 102 aa, Artificial; identical to SEQ ID NO: 18
  P,R,S 103-class Nanobody
  misc_feature (31)..(35): Xaa is any amino acid
  misc_feature (50)..(54): Xaa is any amino acid
  misc_feature (87)..(91): Xaa is any amino acid

SEQ ID NO: 23 - protein, 30 aa, Artificial
  KERE-class Nanobody FW1 sequence
QVQRVESGGGLVQAGGSLRLSCAASGRTSS

SEQ ID NO: 24 - protein, 30 aa, Artificial
  KERE-class Nanobody FW1 sequence
QVQLVESGGGLVQTGDSLSLSCSASGRTFS

SEQ ID NO: 25 - protein, 30 aa, Artificial
  KERE-class Nanobody FW1 sequence
QVKLEESGGGLVQAGDSLRLSCAATGRAFG

SEQ ID NO: 26 - protein, 30 aa, Artificial
  KERE-class Nanobody FW1 sequence
AVQLVESGGGLVQPGESLGLSCVASGRDFV

SEQ ID NO: 27 - protein, 30 aa, Artificial
  KERE-class Nanobody FW1 sequence
EVQLVESGGGLVQAGGSLRLSCEVLGRTAG

SEQ ID NO: 28 - protein, 30 aa, Artificial
  KERE-class Nanobody FW1 sequence
QVQLVESGGGWVQPGGSLRLSCAASETILS

SEQ ID NO: 29 - protein, 30 aa, Artificial
  KERE-class Nanobody FW1 sequence
QVQLVESGGGTVQPGGSLNLSCVASGNTFN

SEQ ID NO: 30 - protein, 30 aa, Artificial
  KERE-class Nanobody FW1 sequence
EVQLVESGGGLAQPGGSLQLSCSAPGFTLD

SEQ ID NO: 31 - protein, 30 aa, Artificial
  KERE-class Nanobody FW1 sequence
AQELEESGGGLVQAGGSLRLSCAASGRTFN

SEQ ID NO: 32 - protein, 22 aa, Artificial
  KERE-class Nanobody FW1 sequence
VESGGGLVQPGGSLRLSCAASG

SEQ ID NO: 33 - protein, 22 aa, Artificial
  KERE-class Nanobody FW1 sequence
VDSGGGLVQAGDSLKLSCALTG

SEQ ID NO: 34 - protein, 22 aa, Artificial
  KERE-class Nanobody FW1 sequence
VDSGGGLVQAGDSLRLSCAASG

SEQ ID NO: 35 - protein, 22 aa, Artificial
  KERE-class Nanobody FW1 sequence
VDSGGGLVEAGGSLRLSCQVSE

SEQ ID NO: 36 - protein, 22 aa, Artificial
  KERE-class Nanobody FW1 sequence
QDSGGGSVQAGGSLKLSCAASG

SEQ ID NO: 37 - protein, 22 aa, Artificial
  KERE-class Nanobody FW1 sequence
VQSGGRLVQAGDSLRLSCAASE

SEQ ID NO: 38 - protein, 22 aa, Artificial
  KERE-class Nanobody FW1 sequence
VESGGTLVQSGDSLKLSCASST

SEQ ID NO: 39 - protein, 22 aa, Artificial
  KERE-class Nanobody FW1 sequence
MESGGDSVQSGGSLTLSCVASG

SEQ ID NO: 40 - protein, 22 aa, Artificial
  KERE-class Nanobody FW1 sequence
QASGGGLVQAGGSLRLSCSASV

SEQ ID NO: 41 - protein, 14 aa, Artificial
  KERE-class Nanobody FW2 sequence
WFRQAPGKEREFVA

SEQ ID NO: 42 - protein, 14 aa, Artificial
  KERE-class Nanobody FW2 sequence
WFRQTPGREREFVA

SEQ ID NO: 43 - protein, 14 aa, Artificial
  KERE-class Nanobody FW2 sequence
WYRQAPGKQREMVA

SEQ ID NO: 44 - protein, 14 aa, Artificial
  KERE-class Nanobody FW2 sequence
WYRQGPGKQRELVA

SEQ ID NO: 45 - protein, 14 aa, Artificial
  KERE-class Nanobody FW2 sequence
WIRQAPGKEREGVS

SEQ ID NO: 46 - protein, 14 aa, Artificial
  KERE-class Nanobody FW2 sequence
WFREAPGKEREGIS

SEQ ID NO: 47 - protein, 14 aa, Artificial
  KERE-class Nanobody FW2 sequence
WYRQAPGKERDLVA

SEQ ID NO: 48 - protein, 14 aa, Artificial
  KERE-class Nanobody FW2 sequence
WFRQAPGKQREEVS

SEQ ID NO: 49 - protein, 14 aa, Artificial
  KERE-class Nanobody FW2 sequence
WFRQPPGKVREFVG

SEQ ID NO: 50 - protein, 32 aa, Artificial
  KERE-class Nanobody FW3 sequence
RFTISRDNAKNTVYLQMNSLKPEDTAVYRCYF

SEQ ID NO: 51 - protein, 32 aa, Artificial
  KERE-class Nanobody FW3 sequence
RFAISRDNNKNTGYLQMNSLEPEDTAVYYCAA

SEQ ID NO: 52 - protein, 32 aa, Artificial
  KERE-class Nanobody FW3 sequence
RFTVARNNAKNTVNLEMNSLKPEDTAVYYCAA

SEQ ID NO: 53 - protein, 32 aa, Artificial
  KERE-class Nanobody FW3 sequence
RFTISRDIAKNTVDLLMNNLEPEDTAVYYCAA

SEQ ID NO: 54 - protein, 32 aa, Artificial
  KERE-class Nanobody FW3 sequence
RLTISRDNAVDTMYLQMNSLKPEDTAVYYCAA

SEQ ID NO: 55 - protein, 32 aa, Artificial
  KERE-class Nanobody FW3 sequence
RFTISRDNAKNTVYLQMDNVKPEDTAIYYCAA

SEQ ID NO: 56 - protein, 32 aa, Artificial
  KERE-class Nanobody FW3 sequence
RFTISKDSGKNTVYLQMTSLKPEDTAVYYCAT

SEQ ID NO: 57 - protein, 32 aa, Artificial
  KERE-class Nanobody FW3 sequence
RFTISRDSAKNMMYLQMNNLKPQDTAVYYCAA

SEQ ID NO: 58 - protein, 32 aa, Artificial
  KERE-class Nanobody FW3 sequence
RFTISRENDKSTVYLQLNSLKPEDTAVYYCAA

SEQ ID NO: 59 - protein, 32 aa, Artificial
  KERE-class Nanobody FW3 sequence
RFTISRDYAGNTAYLQMNSLKPEDTGVYYCAT

SEQ ID NO: 60 - protein, 11 aa, Artificial
  KERE-class Nanobody FW4 sequence
WGQGTQVTVSS

SEQ ID NO: 61 - protein, 11 aa, Artificial
  KERE-class Nanobody FW4 sequence
WGKGTLVTVSS

SEQ ID NO: 62 - protein, 11 aa, Artificial
  KERE-class Nanobody FW4 sequence
RGQGTRVTVSS

SEQ ID NO: 63 - protein, 11 aa, Artificial
  KERE-class Nanobody FW4 sequence
WGLGTQVTISS

SEQ ID NO: 64 - protein, 30 aa, Artificial
  GLEW-class Nanobody FW1 sequence
QVQLVESGGGLVQPGGSLRLSCAASGFTFS

SEQ ID NO: 65 - protein, 30 aa, Artificial
  GLEW-class Nanobody FW1 sequence
EVHLVESGGGLVRPGGSLRLSCAAFGFIFK

SEQ ID NO: 66 - protein, 30 aa, Artificial
  GLEW-class Nanobody FW1 sequence
QVKLEESGGGLAQPGGSLRLSCVASGFTFS

SEQ ID NO: 67 - protein, 30 aa, Artificial
  GLEW-class Nanobody FW1 sequence
EVQLVESGGGLVQPGGSLRLSCVCVSSGCT

SEQ ID NO: 68 - protein, 30 aa, Artificial
  GLEW-class Nanobody FW1 sequence
EVQLVESGGGLALPGGSLTLSCVFSGSTFS

SEQ ID NO: 69 - protein, 22 aa, Artificial
  GLEW-class Nanobody FW1 sequence
VESGGGLVQPGGSLRLSCAASG

SEQ ID NO: 70 - protein, 22 aa, Artificial
  GLEW-class Nanobody FW1 sequence
EESGGGLAQPGGSLRLSCVASG

SEQ ID NO: 71 - protein, 22 aa, Artificial
  GLEW-class Nanobody FW1 sequence
VESGGGLALPGGSLTLSCVFSG

SEQ ID NO: 72 - protein, 14 aa, Artificial
  GLEW-class Nanobody FW2 sequence
WVRQAPGKVLEWVS

SEQ ID NO: 73 - protein, 14 aa, Artificial
  GLEW-class Nanobody FW2 sequence
WVRRPPGKGLEWVS

SEQ ID NO: 74 - protein, 14 aa, Artificial
  GLEW-class Nanobody FW2 sequence
WVRQAPGMGLEWVS

SEQ ID NO: 75 - protein, 14 aa, Artificial
  GLEW-class Nanobody FW2 sequence
WVRQAPGKEPEWVS

SEQ ID NO: 76 - protein, 14 aa, Artificial
  GLEW-class Nanobody FW2 sequence
WVRQAPGKDQEWVS

SEQ ID NO: 77 - protein, 14 aa, Artificial
  GLEW-class Nanobody FW2 sequence
WVRQAPGKAEEWVS

SEQ ID NO: 78 - protein, 14 aa, Artificial
  GLEW-class Nanobody FW2 sequence
WVRQAPGKGLEWVA

SEQ ID NO: 79 - protein, 14 aa, Artificial
  GLEW-class Nanobody FW2 sequence
WVRQAPGRATEWVS

SEQ ID NO: 80 - protein, 32 aa, Artificial
  GLEW-class Nanobody FW3 sequence
RFTISRDNAKNTLYLQMNSLKPEDTAVYYCVK

SEQ ID NO: 81 - protein, 32 aa, Artificial
  GLEW-class Nanobody FW3 sequence
RFTISRDNARNTLYLQMDSLIPEDTALYYCAR

SEQ ID NO: 82 - protein, 32 aa, Artificial
  GLEW-class Nanobody FW3 sequence
RFTSSRDNAKSTLYLQMNDLKPEDTALYYCAR

SEQ ID NO: 83 - protein, 32 aa, Artificial
  GLEW-class Nanobody FW3 sequence
RFIISRDNAKNTLYLQMNSLGPEDTAMYYCQR

SEQ ID NO: 84 - protein, 32 aa, Artificial
  GLEW-class Nanobody FW3 sequence
RFTASRDNAKNTLYLQMNSLKSEDTARYYCAR

SEQ ID NO: 85 - protein, 32 aa, Artificial
  GLEW-class Nanobody FW3 sequence
RFTISRDNAKNTLYLQMDDLQSEDTAMYYCGR

SEQ ID NO: 86 - protein, 11 aa, Artificial
  GLEW-class Nanobody FW4 sequence
GSQGTQVTVSS

SEQ ID NO: 87 - protein, 11 aa, Artificial
  GLEW-class Nanobody FW4 sequence
LRGGTQVTVSS

SEQ ID NO: 88 - protein, 11 aa, Artificial
  GLEW-class Nanobody FW4 sequence
RGQGTLVTVSS

SEQ ID NO: 89 - protein, 11 aa, Artificial
  GLEW-class Nanobody FW4 sequence
RSRGIQVTVSS

SEQ ID NO: 90 - protein, 11 aa, Artificial
  GLEW-class Nanobody FW4 sequence
WGKGTQVTVSS

SEQ ID NO: 91 - protein, 11 aa, Artificial
  GLEW-class Nanobody FW4 sequence
WGQGTQVTVSS

SEQ ID NO: 92 - protein, 30 aa, Artificial
  P,R,S 103-class Nanobody FW1 sequence
AVQLVESGGGLVQAGGSLRLSCAASGRTFS

SEQ ID NO: 93 - protein, 30 aa, Artificial
  P,R,S 103-class Nanobody FW1 sequence
QVQLQESGGGMVQPGGSLRLSCAASGFDFG

SEQ ID NO: 94 - protein, 30 aa, Artificial; identical to SEQ ID NO: 65
  P,R,S 103-class Nanobody FW1 sequence

SEQ ID NO: 95 - protein, 30 aa, Artificial
  P,R,S 103-class Nanobody FW1 sequence
QVQLAESGGGLVQPGGSLKLSCAASRTIVS

SEQ ID NO: 96 - protein, 30 aa, Artificial
  P,R,S 103-class Nanobody FW1 sequence
QEHLVESGGGLVDIGGSLRLSCAASERIFS

SEQ ID NO: 97 - protein, 30 aa, Artificial; identical to SEQ ID NO: 66
  P,R,S 103-class Nanobody FW1 sequence

SEQ ID NO: 98 - protein, 30 aa, Artificial; identical to SEQ ID NO: 67
  P,R,S 103-class Nanobody FW1 sequence

SEQ ID NO: 99 - protein, 30 aa, Artificial; identical to SEQ ID NO: 68
  P,R,S 103-class Nanobody FW1 sequence

SEQ ID NO: 100 - protein, 22 aa, Artificial
  P,R,S 103-class Nanobody FW1 sequence
VESGGGLVQAGGSLRLSCAASG

SEQ ID NO: 101 - protein, 22 aa, Artificial
  P,R,S 103-class Nanobody FW1 sequence
AESGGGLVQPGGSLKLSCAASR

SEQ ID NO: 102 - protein, 14 aa, Artificial
  P,R,S 103-class Nanobody FW2 sequence
WFRQAPGKEREFVA

SEQ ID NO: 103 - protein, 14 aa, Artificial
  P,R,S 103-class Nanobody FW2 sequence
WVRQAPGKVLEWVS

SEQ ID NO: 104 - protein, 14 aa, Artificial
  P,R,S 103-class Nanobody FW2 sequence
WVRRPPGKGLEWVS

SEQ ID NO: 105 - protein, 14 aa, Artificial
  P,R,S 103-class Nanobody FW2 sequence
WIRQAPGKEREGVS

SEQ ID NO: 106 - protein, 14 aa, Artificial
  P,R,S 103-class Nanobody FW2 sequence
WVRQYPGKEPEWVS

SEQ ID NO: 107 - protein, 14 aa, Artificial
  P,R,S 103-class Nanobody FW2 sequence
WFRQPPGKEHEFVA

SEQ ID NO: 108 - protein, 14 aa, Artificial
  P,R,S 103-class Nanobody FW2 sequence
WYRQAPGKRTELVA

SEQ ID NO: 109 - protein, 14 aa, Artificial
  P,R,S 103-class Nanobody FW2 sequence
WLRQAPGQGLEWVS

SEQ ID NO: 110 - protein, 14 aa, Artificial
  P,R,S 103-class Nanobody FW2 sequence
WLRQTPGKGLEWVG

SEQ ID NO: 111 - protein, 14 aa, Artificial
  P,R,S 103-class Nanobody FW2 sequence
WVRQAPGKAEEFVS

SEQ ID NO: 112 - protein, 32 aa, Artificial
  P,R,S 103-class Nanobody FW3 sequence
RFTISRDNAKNTVYLQMNSLKPEDTAVYYCAA

SEQ ID NO: 113 - protein, 32 aa, Artificial; identical to SEQ ID NO: 81
  P,R,S 103-class Nanobody FW3 sequence

SEQ ID NO: 114 - protein, 32 aa, Artificial
  P,R,S 103-class Nanobody FW3 sequence
RFTISRDNAKNEMYLQMNNLKTEDTGVYWCGA

SEQ ID NO: 115 - protein, 32 aa, Artificial
  P,R,S 103-class Nanobody FW3 sequence
RFTISSDSNRNMIYLQMNNLKPEDTAVYYCAA

SEQ ID NO: 116 - protein, 32 aa, Artificial
  P,R,S 103-class Nanobody FW3 sequence
RFTISRDNAKNMLYLHLNNLKSEDTAVYYCRR

SEQ ID NO: 117 - protein, 32 aa, Artificial
  P,R,S 103-class Nanobody FW3 sequence
RFTISRDNAKKTVYLRLNSLNPEDTAVYSCNL

SEQ ID NO: 118 - protein, 32 aa, Artificial
  P,R,S 103-class Nanobody FW3 sequence
RFKISRDNAKKTLYLQMNSLGPEDTAMYYCQR

SEQ ID NO: 119 - protein, 32 aa, Artificial
  P,R,S 103-class Nanobody FW3 sequence
RFTVSRDNGKNTAYLRMNSLKPEDTADYYCAV

SEQ ID NO: 120 - protein, 11 aa, Artificial
  P,R,S 103-class Nanobody FW4 sequence
RGQGTQVTVSS

SEQ ID NO: 121 - protein, 11 aa, Artificial
  P,R,S 103-class Nanobody FW4 sequence
LRGGTQVTVSS

SEQ ID NO: 122 - protein, 11 aa, Artificial
  P,R,S 103-class Nanobody FW4 sequence
GNKGTLVTVSS

SEQ ID NO: 123 - protein, 11 aa, Artificial
  P,R,S 103-class Nanobody FW4 sequence
SSPGTQVTVSS

SEQ ID NO: 124 - protein, 11 aa, Artificial
  P,R,S 103-class Nanobody FW4 sequence
SSQGTLVTVSS

SEQ ID NO: 125 - protein, 11 aa, Artificial
  P,R,S 103-class Nanobody FW4 sequence
RSRGIQVTVSS

SEQ ID NO: 126 - protein, 124 aa, Artificial
  Nanobody sequence
EVQLVESGGGLVQAGDSLRLSCIDSGRTFSDYPIGWFRQAPGKEREFVAAIYAIGGDVYYADSVKGRFTISRDNAKNTVYLQMSSLKPEDTAIYSCAVASGGGSIRSARRYDYWGRGTQVTVSS

SEQ ID NO: 127 - protein, 126 aa, Artificial
  Nanobody sequence
EVQLVESGGGLVQAGGSLRLSCAASGGTFSSYAMGWFRQAPGKERDFVSAITWSGGSTYYADSVKGRFTISRDNAKNTVYLQMNSLKPEDTAVYYCAADDQKYDYIAYAEYEYDYWGQGTQVTVSS

SEQ ID NO: 128 - protein, 120 aa, Artificial
  Nanobody sequence
EVQLVESGGDLVQPGGSLRLSCAASGFTFRGYWMTWVRQAPGKGLEWVSSINNIGEEAYYVDSVKGRFTISRDNAKNTLYLQMNSLKSEDTAVYYCVKDWASDYAGYSPNSQGTQVTVSS

SEQ ID NO: 129 - protein, 120 aa, Artificial
  Nanobody sequence
EVQLVESGGGSVQPGGSLRLSCAASGFTFRGYWMSWVRQAPGKGLEWVSAINNVGGDTYYADSVKGRFTISRDNAKNMLYLQMNSLKAEDTAVYYCARDWHNDPNKNEYKGQGTQVTVSS

SEQ ID NO: 130 - protein, 120 aa, Artificial
  Nanobody sequence
EVQLVESGGGLVQPGGSLRLSCAASGFTFRGYWMSWVRQAPGKGLEWVSAINNVGDEVYYADSVKGRFTISRDNAKNTLYLQMNSLKSEDTAVYYCTRDWYNDPNKNEYKGQGTQVTVSS

SEQ ID NO: 131 - protein, 120 aa, Artificial
  Nanobody sequence
EVQLVESGGGLVQPGGSLRLSCAASGFTFRGYWMSWVRQAPGKGLEWVSAINNVGDEVYYADSVKGRFTISRDNAKNTLYLQMNSLKSEDTAVYYCTRDWFDDPNKNEYKGQGTQVTVSS

SEQ ID NO: 132 - protein, 120 aa, Artificial
  Nanobody sequence
EVQLVESGGGLVQPGGSLRLSCAASGFTFSGYWMSWVRQAPGKGLEWVSAISNSGGETYYADSVKGRFTISRDNAKNTLYLQMNSLRSEDTAVYYCTRDWHSDPNKHEYRGQGTQVTVSS

SEQ ID NO: 133 - protein, 120 aa, Artificial
  Nanobody sequence
EVQLVESGGGSVQPGGSLRLSCAASGFTFRGYWMSWVRQAPGKGLEWVSAINNLGGDTYYADSVKGRFTISRDNAKNMLYLQMNSLKAEDTAVYYCARDWYDDPNKNEYKGQGTQVTVSS

SEQ ID NO: 134 - protein, 120 aa, Artificial
  Nanobody sequence
KVQLVESGGDLVQPGGSLRLSCAASGFTFRGYWMTWVRQAPGKGLEWVSSINNIGEEAYYVDSVKGRFTISRDNAKNTLYLQMNSLKSEDTAVYYCVKDWASDYAGYSPNSQGTQVTVSS

SEQ ID NO: 135 - protein, 120 aa, Artificial; identical to SEQ ID NO: 129
  Nanobody sequence

SEQ ID NO: 136 - protein, 120 aa, Artificial; identical to SEQ ID NO: 128
  Nanobody sequence

SEQ ID NO: 137 - protein, 120 aa, Artificial
  Nanobody sequence
EVQLVESGGGLVQPGGSLRLSCAASGFTFSGYWMSWVRQAPGKGLEWVSAINNVGDETYYANSVKGRFTIARDNTKRTLYLQMNSLKSEDTAVYYCTRDWHSEPNKYEYKGQGTQVTVSS

SEQ ID NO: 138 - protein, 119 aa, Artificial
  Nanobody sequence
EVQLVESGGGLVQPGGSLRLSCTGSGFTFSSYWMDWVRQTPGKDLEYVSGISPSGSNTDYADSVKGRFTISRDNAKNTLYLQMNSLKPEDTALYYCRRSLTLTDSPDLRSQGTQVTVSS

SEQ ID NO: 139 - protein, 120 aa, Artificial
  Nanobody sequence
EVQLVESGGGLVQPGGSLRLSCAASGFTFRGYWMSWVRQAPGKGLEWVSAINNVGGETYYADSVKGRFTISRDNAKNALYLQMNSLKSEDTAVYYCARDWYNDPNKNEYKGQGTQVTVSS

SEQ ID NO: 140 - protein, 115 aa, Artificial
  Nanobody sequence
EVQLVESGGGLVQAGGSLRLSCAASGSTGSSTAMGWSRQAPGKQREWVASISSAGTIRYVDSVKGRFTISRDNAKNTGYLQMNSLKPEDTAVYYCYVVGNFTTYWGRGTQVTVSS

SEQ ID NO: 141 - protein, 120 aa, Artificial; identical to SEQ ID NO: 133
  Nanobody sequence

SEQ ID NO: 142 - protein, 120 aa, Artificial; identical to SEQ ID NO: 130
  Nanobody sequence

SEQ ID NO: 143 - protein, 120 aa, Artificial; identical to SEQ ID NO: 130
  Nanobody sequence

SEQ ID NO: 144 - protein, 120 aa, Artificial
  Nanobody sequence
EVQLVESGGGLVQPGGSLRLSCAASGFTFGGYWMTWVRQAPGKGLEWVSSIANDGKSTYYVDSVKGRFSISRDNAKNTLYLQMNSLKSEDTAVYYCVRDWASDYAGYSPNSQGTQVTVSS

SEQ ID NO: 145 - protein, 120 aa, Artificial
  Nanobody sequence
EVQLVESGGDLVQPGGSLRLSCAASGFTFRGYWMTWVRQAPGKGLEWVSSINNIGEETYYVDSVKGRFTISRDNAKNTLYLQMNSLKSEDTAVYYCVKDWASDYAGYSPNSQGTQVTVSS

SEQ ID NO: 146 - protein, 127 aa, Artificial
  Nanobody sequence
EVQLVESGGGLVQAGGSLRLSCAASGRTFSSYAMGWFRQAPGKEREFVAAISWSGRTTYYADFVKGRFTISRDNAKNTVYLQMNSLKPEDTAVYYCAADLSPGNEYGEMMEYEYDYWGEGTQVTVSS

SEQ ID NO: 147 - protein, 120 aa, Artificial
  Nanobody sequence
EVQLVESGGGLVQPGGSLRLSCAASGFTFRGYWMSWVRQAPGKGLEWVSAINNVGGETYYADSVKGRFTISRDNAKNTLYLQMNSLKSEDTAAYYCARDWYNDPNKNEYKGQGTQVTVSS

SEQ ID NO: 148 - protein, 120 aa, Artificial; identical to SEQ ID NO: 133
  Nanobody sequence

SEQ ID NO: 149 - protein, 120 aa, Artificial
  Nanobody sequence
EVQLVESGGGLVQPGGSLRLSCAASGFTFSGYWMSWVRQAPGKGLEWVSAINNVGGDTYYADSVKGRFTISRDNAKNTLYLQMNSLKSEDTAVYYCARDWYNDPNKNEYKGQGTQVTVSS

SEQ ID NO: 150 - protein, 120 aa, Artificial; identical to SEQ ID NO: 128
  Nanobody sequence

SEQ ID NO: 151 - protein, 120 aa, Artificial; identical to SEQ ID NO: 128
  Nanobody sequence

SEQ ID NO: 152 - protein, 122 aa, Artificial
  Nanobody sequence
EVQLVESGGGLVQPGGSLRLSCAASGLIFSSYDMGWFRQAPGEERAFVGAISRSGDVRYVDPVKGRFTITRDNAKNTVYLQMNSLKPEDTAVYYCAADADGWWHRGQAYHWWGQGTQVTVSS

SEQ ID NO: 153 - protein, 120 aa, Artificial; identical to SEQ ID NO: 147
  Nanobody sequence

SEQ ID NO: 154 - protein, 124 aa, Artificial
  Nanobody sequence
EVQLMESGGGLVQAGGSLRLSCAASGRTFSGYTMGWFRQAPGKGREWVAGISWSGDSTYYADSVKGRFTISREDAKNTVYLQMNSLKPGDTADYYCAAECAMYGSSWPPPCMDWGQGTQVTVSS

SEQ ID NO: 155 - protein, 120 aa, Artificial; identical to SEQ ID NO: 133
  Nanobody sequence

SEQ ID NO: 156 - protein, 120 aa, Artificial
  Nanobody sequence
EVQLVESGGDLVQPGGSLRLSCAASGFTFSGYWMTWVRQAPGKGLEWVSSINNIGEEVYYVDSVKGRFTISRDNAKNTLYLQMNSLKSEDTAVYYCVKDWASDYAGYSPNSQGTQVTVSS

SEQ ID NO: 157 - protein, 120 aa, Artificial; identical to SEQ ID NO: 129
  Nanobody sequence

SEQ ID NO: 158 - protein, 126 aa, Artificial
  Nanobody sequence
EVQLVESGGGLVQAGGSLRLSCAASGRTFSSSFMAWFRQVLGSDREFVGGISPGGRFTYYADSRKGRFTISGDNANNTVYLQMHSVKPEDTATYYCAADTQFSGYVPKETNEYDYWGQGTQVTVSS

SEQ ID NO: 159 - protein, 128 aa, Artificial
  Nanobody sequence
EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSS

SEQ ID NO: 160 - protein, 121 aa, Artificial
  Nanobody sequence
EVQLVESGGGLVQAGGSLRLSCAASERTVIAYTMGWFRRAPGKERDFVAAMNWNGGNTIYADSAKGRFTISRDNAKNTVYLQMNSLKAEDTAVYYCAARPRFWGSYEYDYWGQGTQVTVSS

SEQ ID NO: 161 - protein, 123 aa, Artificial
  Nanobody sequence
EVQLVESGGGLVQPGGSLRLSCAASGLTFRNYAIGWFRQAPGKEREGVSCINSGGSITDYLDSVKGRFAISRDNAKSTVYLQMNSLKPEDTAVYYCATDLTSSCPIYSGTDYWGKGTLVTVSS

SEQ ID NO: 162 - protein, 125 aa, Artificial
  Nanobody sequence
EVQLVESGGGLVQAGGSLRLSCAASEGYFRNYMVGWFRQAPGGERMFVAAISDTAYYADSVKGRFTISRDNAKNTVYLPMNSLKPEDTAVYYCAAAPKSWGTWPLVADTRSYHFWGQGTQVTVSS

SEQ ID NO: 163 - protein, 129 aa, Artificial
  Nanobody sequence
EVQLVESGGGLVQAGGSLRLSCEASGRTFSSYAMVGWFRQAPGKEREFVAAVTRWSGARTVYADSVKGRFTISRDNAENTVYLQMNSLKPEDTAVYTCAADSTNRNSGAVYYSWAYDYWGQGTQVTVSS

SEQ ID NO: 164 - protein, 128 aa, Artificial
  Nanobody sequence
EVQLVESGGGLVQAGGSLRLSCEASGRTERYQAMGWFRQAPGKEREFVAVVTRWSGARTVYADSVKGRFTISRDNAENTVYLQMNSLKPEDTAVYTCAADSTNRNRGAIYYTWAYDYWGQGTQVTVSS

SEQ ID NO: 165 - protein, 130 aa, Artificial
  Nanobody sequence
EVQLVESGGGLVQAGGSLRLSCATSGRTRSRYTMGWFRQAPGKEREFVAAISWSDDSTYYRDSVKGRFTISRDNAKKTVYLQMNTLKPEDTAVYYCAADSAFGTGYSDNYYSTSEEYDYWGQGTQVTVSS

SEQ ID NO: 166 - protein, 127 aa, Artificial
  Nanobody sequence
EVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSS

SEQ ID NO: 167 - protein, 128 aa, Artificial
  Nanobody sequence
EVQLVESGGGLVQAGGSLRLSCEASGRTFSPIAMGWFRQAPGKEREFVAVVTRWSGARTVYADSVKGRFTISRDNAENTVYLQMNSLKPEDTAVYTCAADSTNRNSGAIYYTWAYDYWGQGTQVTVSS

SEQ ID NO: 168 - protein, 112 aa, Artificial
  Nanobody sequence
EVQLVESGGGLVQAGGSLRLSCAASGIIFSTNHMGWYRRAPGKQRELVGTINRGDSPYYADSVKGRFTISRDNAKNMVYLQMNSLKPEDTAVYYCNAGYIYWGQGTQVTVSS

SEQ ID NO: 169 - protein, 128 aa, Artificial
  Nanobody sequence
EVQLVESGGGLVQAGGSLRLSCEASGRTFSNYAMGWFRQAPGKEREFVAVVTRWSGGRTVYADSVKGRFTISRDNAENTVYLQMNSLKPEDTAVYTCAADSTNRNSGAWYYTWAYDHWGQGTQVTVSS

SEQ ID NO: 170 - protein, 121 aa, Artificial
  Nanobody sequence
EVQLVESGGGLVQAGGSLRLSCTASGRTFSSYAMGWFRQTPGKEREFVASISWIGKFTYYADSVKGRFTISGENAKNTVYLQMNSLKPEDTAVYYCAAKTLVGVTTAFDRWGQGTQVTVSS

SEQ ID NO: 171 - protein, 126 aa, Artificial
  Nanobody sequence
EVQLVESGGGLVQTGGSLRLSCAASGRTFSSSFMAWFRQALGSDREFVGGISPGGRITYYADSRKGRFTISRDNANNTVYLQMDSLKPEDTATYYCAADTQYSGVVLKESTDYDYWGQGTQVTVSS

SEQ ID NO: 172 - protein, 126 aa, Artificial; identical to SEQ ID NO: 171
  Nanobody sequence

SEQ ID NO: 173 - protein, 121 aa, Artificial
  Nanobody sequence
EVQLVESGGGLVQAGGSLRLSCAASVRTFSNGAMGWFRQAPGKEREFVASISWSGGSTYYADSVKGRFTISGDNAKSTVYLQMNSLKPEDTAVYYCAVRGVAVTTILWNYWGQGTQVTVSS

SEQ ID NO: 174 - protein, 121 aa, Artificial; identical to SEQ ID NO: 160
  Nanobody sequence

SEQ ID NO: 175 - protein, 121 aa, Artificial; identical to SEQ ID NO: 160
  Nanobody sequence

SEQ ID NO: 176 - protein, 125 aa, Artificial; identical to SEQ ID NO: 162
  Nanobody sequence

SEQ ID NO: 177 - protein, 125 aa, Artificial; identical to SEQ ID NO: 162
  Nanobody sequence

SEQ ID NO: 178 - protein, 128 aa, Artificial; identical to SEQ ID NO: 169
  Nanobody sequence

SEQ ID NO: 179 - protein, 125 aa, Artificial
  Nanobody sequence
EVQLVESGGELVQAGDSLTVSCAASGRTFSVYTMGWFRQAPMKEREFVAAISGGSIRYADSVKGRFAISSDNAGNTVYLQMNNLQPEDTAVYYCAAQGSIVFYSNWDRASQYDYWGQGTQVTVSS

SEQ ID NO: 180 - protein, 127 aa, Artificial
  Nanobody sequence
EVQLVESGGGLVQPGGSLRLSCAASGFTFSSYWMYWVRQAPGKGLEWVSAISTGGGDTHYADSVKGRFTISRDNPKNTLYLQMNSLKPEDTALYYCARNRDSGSSYITFSLADFGSWGQGTQVTVSS

SEQ ID NO: 181 - protein, 128 aa, Artificial; identical to SEQ ID NO: 159
  Nanobody sequence

SEQ ID NO: 182 - protein, 128 aa, Artificial
  Nanobody sequence
EVQLVESGGGLVQPGGSLRLSCAASGSSFSINAMGWFRQAPGKEREFVAVVTRWSGARTVYADSVKGRFTISRDNAENTVYLQMNSLKPEDTAVYTCAADSTNRNSGAVYYTWAYDYWGQGTQVTVSS

SEQ ID NO: 183 - protein, 128 aa, Artificial; identical to SEQ ID NO: 182
  Nanobody sequence

SEQ ID NO: 184 - protein, 128 aa, Artificial
  Nanobody sequence
EMQLVESGGGLVQAGGSLRLSCEASGRSFSSYAMGWFRQAPGKEREFVAAVSRWSGPRTVYADSVKGRFTISRDNAENTVYLQMNSLKPEDTAVYTCAADSTNRNSGAVYYTWAWDYWGQGTQVTVSS

SEQ ID NO: 185 - protein, 129 aa, Artificial
  Nanobody sequence
EVQLVESGGGLVQAGGSLRLSCAASGFTFDDYAIGWFRQAPGKEREGVSCIRCSDGSTYYADSVKGRFTISSDNAKNTVYLQMNSLKPEDTAVYYCAADFSLAQYKTIHRMPPYGMDYWGKGTLVTVSS

SEQ ID NO: 186 - protein, 128 aa, Artificial
  Nanobody sequence
EVQLVESGGGLVQAGGSLRLSCEASGGSFSSYAMGWFRQAPGKEREFVAAVSGWIGPRPVYADSVKGRFTISRDNAENTVYLQMNSLQPEDTAVYTCAADATNRNSGAYYYTWAYDYWGQGTQVTVSS

SEQ ID NO: 187 - protein, 128 aa, Artificial
  Nanobody sequence
EVQLVESGGGLVQAGGSLRLSCEASGRSFSSVAMGWFRQAPGKEREFVAALSRWSGARTVYADSVKGRFTISGDNAENTVYLQMNSLKPEDTAVYTCAADSTNRNSGAVYYTWAYDYWGQGTQVTVSS

SEQ ID NO: 188 - protein, 128 aa, Artificial
  Nanobody sequence
EVQLVESGGGLVQAGGSLRLSCEASGRTFSSYAMGWFRQAPGKEREFVAVVTRWSGGRTVYABSVKGRFTISRDNAENTVYLQMNSLKPEDTAVYTCAADSTNRNSGAWYYTWAYDHWGQGTQVTVSS

SEQ ID NO: 189 - protein, 128 aa, Artificial
  Nanobody sequence
EVQLVESGGGLVQAGGSLRLSCEASGRTFSRYGMGWFRQAPGKEREFVAAVSRLSGPRTVYADSVKGRFTISRDNAENTVYLQMNSLKPEDTAVYTCAAELTNRNSGAYYYTWAYDYWGQGTQVTVSS

SEQ ID NO: 190 - protein, 128 aa, Artificial; identical to SEQ ID NO: 167
  Nanobody sequence

SEQ ID NO: 191 - protein, 128 aa, Artificial
  Nanobody sequence
EVQLVESGGGLVQAGGSLRLSCEASGRTFSSVAMGWFRQAPGKEREFVAAVSRWSGARTVYADSVKGRFTISGDNAENTVYLQMNSLKPEDTAVYTCAADSTNRNSGAVYYPWAYDYWGQGTQVTVSS

SEQ ID NO: 192 - protein, 129 aa, Artificial
  Nanobody sequence
EVQLVESGGGLVQAGGSLRLSCEASRRTFSSYAMVGWFRQAPGKEREFVAAVTRWSGARTVYADSVKGRFTISRDNAENTVYLQMNSLKPEDTAVYTCAADSTNRNSGAVYYSWAYDYWGQGTQVTVSS

SEQ ID NO: 193 - protein, 128 aa, Artificial
  Nanobody sequence
EVQLVESGGGLVQAGGSLRLSCEASGRTERYQAMGWFRQAPGKEREFVAVVTRWSGARTVYADSVKGRFTISRDNAENTVYLQMNSLKPEDTAVYTCAADSTNRNSGAIYYTWAYDYWGQGTQVTVSS

SEQ ID NO: 194 - protein, 129 aa, Artificial; identical to SEQ ID NO: 163
  Nanobody sequence

SEQ ID NO: 195 - protein, 122 aa, Artificial
  Nanobody sequence
EVQLVESGGGLVQPGGSLGLSCAASGNIFSITGMGWYRQAPGNQRELVAQISHYDSTMYADSVKGRFTISRDNAKNTVYLQMNSLKPEDTAVYYCNAQIIPRVMPLRSNDYWGQGTQVTVSS

SEQ ID NO: 196 - protein, 118 aa, Artificial
  Nanobody sequence
EVQLVESGGGSVQPGGSARLSCAVLGSIGSLNAMGWYRQTPGKERELVARITSLGPIMYAEFVKGRFTISRDNDKNTVYLQMNSLKPEDTAVYYCKTRWYEGIWREYWGQGTRVTVSS

SEQ ID NO: 197 - protein, 125 aa, Artificial
  Nanobody sequence
EVQLVESGGGLAQPGGSLRLSCAASGFTFNDYAMGWFRQAPGKEREFVAGISWAGHNTVYAGSMKGRFTVSRDNAENTLYLQMNSLESEDTAVYYCAKSLGTIWYQKDYRAYDAWGRGTQVTVSS

SEQ ID NO: 198 - protein, 121 aa, Artificial; identical to SEQ ID NO: 160
  Nanobody sequence

SEQ ID NO: 199 - protein, 125 aa, Artificial
  Nanobody sequence
EVQLVESGGGLVQAGGSLRLSCAASERTFIPYPMGWFRQAPGKEREFVGAISGGGFPTFYADSVKGRFTISRDNAENTVYLQMNSLKPEDTAVYFCARNRQGEVFRTTRLDYDSWGRGTQVTVSS

SEQ ID NO: 200 - protein, 121 aa, Artificial
  Nanobody sequence
EVQLVESGGGLVQPGGSLRLSCAASGFVFSHYAMSWVRQAPGKGLEWVSDITHGGLSTTYRDSVKGRFTISRDNAKNTLYLQMDSLKPEDTAVYYCSKDRYPFVSREYDYRGQGTQVTVSS

SEQ ID NO: 201 - protein, 119 aa, Artificial
  Nanobody sequence
EVQLVESGGGLVQPGGSLTLSCAASGSVFSVNAMGWHRQAPGKERELVAQLTVFGSLNYADSVKGRFSISKDSAKNTVLLQMNSLKPEDTAVYSCNLRQYESDRWRDYWGQGTQVTVSS

SEQ ID NO: 202 - protein, 128 aa, Artificial
  Nanobody sequence
EVQLVESGGGLVQPGGSLRLSCAASGFTFDYYAIGWFRQAPGKEREGVSCISSSDSSTYYADSVKGRFTISRDNAKNTVYLQMNSLKPEDTAVYYCAADFSRSWGTCNEEYYYGMDYWGKGTLVTVSS

SEQ ID NO: 203 - protein, 121 aa, Artificial
  Nanobody sequence
EVQLVESGGGLVQAGGSLRLSCTASGRTLSSYAMGWFRQTPGKEREFVASISWIGKFTYYADSVKGRFTISGENAKNTVYLQMNSLKPEDTAVYYCAAKTIVGGTTAWBRWGQGTQVTVSS

SEQ ID NO: 204 - protein, 121 aa, Artificial
  Nanobody sequence
EVQLVESGGGLVQAGGSLRLSCTAGGDTFSSYAMGWFRQTPGKEREFVASISWIGKFTYYADSVKGRFTISGENAKNTVYLQMNSLKPEDTAVYYCAAKTIVGGTTAWDRWGQGTQVTVSS

SEQ ID NO: 205 - protein, 121 aa, Artificial
  Nanobody sequence
EVQLVESGGGLVQPGGSLRLSCAASGFVFSHYAMSWVRQAPGKGLEWVSDITNGGLSTTYRDSVKGRFTISRDNAKNTLYLQMDSLKPEDTAVYYCSKDLYPFVSREYDYRGQGTQVTVSS

SEQ ID NO: 206 - protein, 123 aa, Artificial
  Nanobody sequence
EVQLVESGGGLVQAGGSLRLSCAAPGRTFSTWVMGWFRQAPGKEREFVARIDWGGSSTSYADIVKGRFTISRDNAKNTVYLQMNSLKPEDAAVYYCAADLDGNGSIDYGYEYWGQGTQVTVSS

SEQ ID NO: 207 - protein, 121 aa, Artificial
  Nanobody sequence
EVQLVESGGGLVQPGGSLRLSCAASGFVFSHYAMSWVRQAPGKGLEWVSBITHGGLTTTYRDSVKGRFTISRDNAKNTLYLQMDSLKPEDTAVYYCSKDRYPFISKEYDYRGQGTQVTVSS

SEQ ID NO: 208 - protein, 119 aa, Artificial
  Nanobody sequence
EVQMVESGGGLVQPGGSLRLSCVASGSIARLNTMGWYRQAPGKQRELVATLSIFGVSDYADSVKGRFTISRDNAKNMVYLQMNSLKPEDTALYFCKQRQHDGGSWYDYWGQGTQVTVSS

SEQ ID NO: 209 - protein, 123 aa, Artificial
  Nanobody sequence
EVQLVESGGGLVQAGGSLRLSCAASGSLFRIFTMGWYRQAPGKQRELVADITTGGSTNYADSVKGRFTISSENAKNTVYLQMNSLKAEDTAVYYCNALGRMAVAHSVSDFNSWGQGTQVTVSS

SEQ ID NO: 210 - protein, 127 aa, Artificial; identical to SEQ ID NO: 166
  Nanobody sequence

SEQ ID NO: 211 - protein, 128 aa, Artificial
  Nanobody sequence
EVQLVESGGGLVQAGGSLRLSCEASGRTFSSYGMGWFRQAPGKEREFVAAVSRLSGPRTVYADSVKGRFTISRDNAENTVYLQMNSLKPEDTAVYTCAAELTNRNPGAYYYTWAYDYWGQGTQVTVSS

SEQ ID NO: 212 - protein, 125 aa, Artificial
  Nanobody sequence
EVQLVESGGGLVQAGGSLRLSCAASGPTFSTMGWFRQAPGKEREFVATIPWSGGIPYYSDSVKGRFTMSRDNAKNTADLQMNSLKPEDTALYYCAGSSRIYIYSDSLSEGSYDYWGQGTQVTVSS

SEQ ID NO: 213 - protein, 127 aa, Artificial; identical to SEQ ID NO: 166
  Nanobody sequence

SEQ ID NO: 214 - protein, 119 aa, Artificial
  Nanobody sequence
EVQLVESGGGLVQPGGSLRLSCAASGSIFSINAMGWYRQAPGKQRDLVAHITFGGSSYYADSVKGRFTISRDNAKNTVYLQMNSLKPEDTAVYYCNARGLGSHRVSDYWGQGTQVTVSS

SEQ ID NO: 215 - protein, 119 aa, Artificial
  Nanobody sequence
EVQLVESGGGLVQPGGSLRLSCAASGSIFSINAMGWYRQAPGKQRDLVAHITFGGNSYYADSVKGRFTISRDNAKNTVYLQMNSLKPEDTAVYYCNARGLGSHRVSDYWGQGTQVTVSS

SEQ ID NO: 216 - protein, 126 aa, Artificial
  Nanobody sequence
EVQLVESGGGLVQAGGSLRLSCVASGRTFNNLAMGWFRQARGKEREFVATISWSHPNTYYTDSVKGRFTISRDDAKNAVYLQMNSLKPEDTAVYYCAANPSYVYSDYLSLAGYTYWGQGTQVTVSS

SEQ ID NO: 217 - protein, 118 aa, Artificial
  Nanobody sequence
EVQLVESGGGLVQAGGSLRLSCAASGSSGVINAMAWHRQAPGKERELVAHISSGGSTYYGDFVKGRFTISRDNAKDTVYLQMNSLKPEDTAVYYCHVPWMDYNRRDYWGQGTQVTVSS

SEQ ID NO: 218 - protein, 123 aa, Artificial; identical to SEQ ID NO: 209
  Nanobody sequence

SEQ ID NO: 219 - protein, 119 aa, Artificial
  Nanobody sequence
EVQLVESGGGLVQPGGSLRLSCAASGSIFSINAMGWYRQAPGKQRELVAHISSGGSTYYGDSVKGRFTISRDNAKNTADLQMNSLKPEDTAVYYCNARTLGAHGIDDYWGQGTQVTVSS

SEQ ID NO: 220 - protein, 127 aa, Artificial; identical to SEQ ID NO: 166
  Nanobody sequence

SEQ ID NO: 221 - protein, 128 aa, Artificial; identical to SEQ ID NO: 169
  Nanobody sequence

SEQ ID NO: 222 - protein, 119 aa, Artificial
  Nanobody sequence
EVQLVESGGGSVQPGGSLRLSCAASGSIVGINAMGWYRQALGKQRELVATIGNGGNTNYADSAKGRFSISRHNAKNSVYLQMNSLKPEDTAVYFCNLKQPENHAITNYWGQGTQVTVSS

SEQ ID NO: 223 - protein, 119 aa, Artificial
  Nanobody sequence
EVQLVESGGGLVQPGGSLRLSCAASGSIFSINAMGWYRQAPGKQRELVAHITSGGSTNYADSVKGRFTISRDNAKNTVYLQMNSLKPEDTAVYYCNHRGAGAHRVDDYWGQGTQVTVSS

SEQ ID NO: 224 - protein, 128 aa, Artificial; identical to SEQ ID NO: 159
  Nanobody sequence

SEQ ID NO: 225 - protein, 123 aa, Artificial
  Nanobody sequence
EVQLVESGGGLVQPGGSLKLSCAASGGFFSIDAMGWYRQAPGKQRELVAAITSGGNTNYADSVKGRFTISRDNAKNTVYLQMNSLKPEDTAVYYCNTEGREARNHGLYEYHSWGQGTQVTVSS

SEQ ID NO: 226 - protein, 121 aa, Artificial
  Nanobody sequence
EVQLVESGGGLVQPGGSLRLSCAASGSIFGLNAMGWYRQVPGKERELVVSISSGGSTTYADSVKGRGRFTISRDDAKNTVYLQMNSLKPEDTGVYYCNARVPGAHYIMDYWGKGTLVTVSS

SEQ ID NO: 227 - protein, 119 aa, Artificial
  Nanobody sequence
EVQLVESGGGLVQPGGSLRLSCAASGSIVGINAMGWYRQAPGKQRELVATIGNGGNTNYADSAKGRFSISRHNAKNSVYLQMNSLKPEDTAVYFCNLKQPENHAITNYWGQGTQVTVSS

SEQ ID NO: 228 - protein, 111 aa, Artificial
  Nanobody sequence
EVQLVESGGGLVQAGGSLKLSCAVSARIFSTNSVDWYRQIPGKQRDWVATITPSPYTYYADSVKGRFTISRDDAKNTVYLHMNSLKPEDTAVYYCKTLDNWGQGTQVTVSS

SEQ ID NO: 229 - protein, 126 aa, Artificial; identical to SEQ ID NO: 158
  Nanobody sequence

SEQ ID NO: 230 - protein, 126 aa, Artificial; identical to SEQ ID NO: 158
  Nanobody sequence

SEQ ID NO: 231 - protein, 124 aa, Artificial
  Nanobody sequence
EVQLVESGGGLVQAGGSLRLSCAASGRTGGTITMAWFRQAPGKEREFVAVISWGGITTSYADSVKGRFTISRDHAKNEQYLEMNSLKPEDTAVYFCTARAGSGLRTTINDYTYWGQGTQVTVSS

SEQ ID NO: 232 - protein, 121 aa, Artificial
  Nanobody sequence
EVQLVESGAGLVQAGGSLRLSCTASGRTFSSYAMGWFRQTPGKEREFVASISWIGEFIYYADSVKGRFTISGENAKNTVYLQMNRLKPEDTAVYYCAAKTLVGDTTAFDRWGQGTQVTVSS

SEQ ID NO: 233 - protein, 126 aa, Artificial
  Nanobody sequence
EVQLVKSGGGLVQAGGSLKLSCAASGRAFSSYTMGWFRQAPGKEREFVASISRDGGTPYYAYSVKGRFTISRDNAKNTVYLQMNSLGPEDTAIYTCAAKENGMFITATQEQSYDYWGQGTQVTVSS

SEQ ID NO: 234 - protein, 121 aa, Artificial; identical to SEQ ID NO: 205
  Nanobody sequence

SEQ ID NO: 235 - protein, 121 aa, Artificial; identical to SEQ ID NO: 160
  Nanobody sequence

SEQ ID NO: 236 - protein, 126 aa, Artificial
  Nanobody sequence
EVQLVESGGGLVQAGGSLRLSCAASGRTFSSSFMAWFRQALGSDREFLGGISPGSRFTYYADSGKGRFTISRDNANNTVYLQMHSLKPEDTATYYCAADTEFSGYVQKESNDYDYWGQGIQVTVSS

SEQ ID NO: 237 - protein, 115 aa, Artificial
  Nanobody sequence
EVQLVESGGGLVQAGGSLRLSCTVSGDTFDNSAAGWYRATSETQRELVARIRSSGSTNYADSVKGRFTVSRDNAKNTVYLQMNSLKPEDTAVYYCNVVSYGEYFWGKGTLVTVSS

SEQ ID NO: 238 - protein, 119 aa, Artificial
  Nanobody sequence
EVQLVESGGGLVQPGGSLRLSCAASGFTFGDSDMSWVRQAPGEGPEWVAGINSGGGSTVYADSVKGRFTISRDNAKNMLYLQMNSLKPEDTAVYLCAQGLMAEVTAGYWGQGTQVTVSS

SEQ ID NO: 239 - protein, 115 aa, Artificial; identical to SEQ ID NO: 237
  Nanobody sequence

SEQ ID NO: 240 - protein, 122 aa, Artificial
  Nanobody sequence
EVQLVESGGGLVQAGASLRLSCAASGSTLSRYGVGWFRQAPGKERELVASVDWSGSRTYYADSVKGRFTISRDNAKNTGYLQMNSLKPDDTAVYYCAADSSVVPGIEKYDDWGLGTQVTVSS

SEQ ID NO: 241 - protein, 124 aa, Artificial
  Nanobody sequence
EVQLVESGGGLVQAGGSLRLSCAASGRTLSSYRMGWFRQAPGKEREFISTISWNGRSTYYADSVKGRFIFSEDNAKNTVYLQMNSLKPEDTAVYYCAAALIGGYYSDVDAWSYWGPGTQVTVSS

SEQ ID NO: 242 - protein, 125 aa, Artificial
  Nanobody sequence
EVQLVKSGGGSVQAGGSLRLSCAASGGTFNPYVMAWFRQAPGNEREFVARIRWSGGDAYYDDSVKGRFAITRDAAKNTVHLQMNSLKPEDTAVYYCAAATYGYGSYTYGGSYDLWGQGTQVTVSS

SEQ ID NO: 243 - protein, 118 aa, Artificial
  Nanobody sequence
EVQLVESGGGLVQPGGSLRLSCAASGFIFGSYDMSWVRQAPGKGPEWVSGINSGGGSTGYADSVKGRFTISRDNAKNTLYLQMNSLKPEDTAVYYCSTNLYPTTDDVWGQGTQVTVSS

SEQ ID NO: 244 - protein, 127 aa, Artificial
  Nanobody sequence
EVQLVESGGGLVQAGGSLRLSCAASGGRTFSRVVAGWFRQAPGKEREFVAAISWDGVQTYYTDSVEGRFTVSRDSAKITVFLQMDNLKPEDTAVYYCAADKGVYTTVSRSMADYGAWGQGTQVTVSS

SEQ ID NO: 245 - protein, 125 aa, Artificial
  Nanobody sequence
EVQLVESGGGSVQAGGSLRLSCAASGGTFNPYVMAWFRQAPGNEREFVARIRWSGGDAYYDDSVKGRFAITRDAAKNTVHLQMNSLKPEDTAVYYCAAATYGYGSYTYGGSYDLWGQGTQVTVSS

SEQ ID NO: 246 - protein, 117 aa, Artificial
  Nanobody sequence
EVQLVESGGDLVQAGGSLRLSCVASGSTYSINAMGWYRQAPGKLRELVAAFRTGGSTDYADSVKGRFTISRDTAKNTVYLQMNSLKPEDTAVYYCNAEVIYYPYDYWGQGTQVTVSS

SEQ ID NO: 247 - protein, 125 aa, Artificial; identical to SEQ ID NO: 245
  Nanobody sequence

SEQ ID NO: 248 - protein, 125 aa, Artificial
  Nanobody sequence
EVQLVESGGGLAQAGGSLRLSCAASGRTLTSYIMGWFRQAPGKERMFVAAISGTGTIKYYGDLVKGRFTISRDNAKNTVYLQIDSLQPEDTAVYYCAARQDYGLGYRDLHEYDYWGQGTQVTVSS

SEQ ID NO: 249 - protein, 125 aa, Artificial
  Nanobody sequence
EVQLVESGGGLVQPGGSLRVSCAASGFTFNDYIMGWFRQAPGKERMFIAAISGTGTIKYYGDLVRGRFTISRDNAKNTVYLRIDSLNPEDTAVYYCAARQDYGLGYRESHEYDYWGQGTQVTVSS

SEQ ID NO: 250 - protein, 125 aa, Artificial
  Nanobody sequence
EVQLVESGGGLVQPGGSLRVSCAASGFTFNSYIMGWFRQAPGKERMFIAAISGTGTIKYYGDLVGGRFTISRDNAKNTVYLRIDSLNPEDTAVYYCAARQDYGLGYRESHEYDYWGQGTQVTVSS

SEQ ID NO: 251 - protein, 125 aa, Artificial
  Nanobody sequence
EVQLVESGGGLVQPGGSLRLSCAASGFTFNSYIMGWFRQAPGKERMFIAAISGTGTIKYYGDLVGGRFTISRDNAKNTVYLRIDSLNPEDTAVYYCAARQDYGLGYRESHEYDYWGQGTQVTVSS

SEQ ID NO: 252 - protein, 124 aa, Artificial
  Nanobody sequence
EVQLVESGGGLVQAGGSLRLSCVASGGTFSTYGMGWFRQAAGKEREFAVAISRSGANIYYGTSTQGRFTISRDNAKNTLYLQMNSLEPEDTAVYYCAASKEWDISASGDDYDYWGQGTQVTVSS

SEQ ID NO: 253 - protein, 114 aa, Artificial
  Nanobody sequence
EVQLVESGGGLVQPGGSLRLSCTAYGFIFDRSRMFWARQAPGKGFEWLSSILTAGDTWYSDSVKGRFTISRDNAKNTLYLQMNDLKSEDTAVYYCSKDGIYSSKGQGTQVTVSS

SEQ ID NO: 254 - protein, 114 aa, Artificial; identical to SEQ ID NO: 253
  Nanobody sequence

SEQ ID NO: 255 - protein, 114 aa, Artificial
  Nanobody sequence
EVQLVESGGGLVQPGGSLRLSCTAYGFIFDRSRMFWARQAPGKGFEWLSSILTAGDTWYSDSVKGRFTISRDNAKNTLYLQMNDLKSEDTAVYYCSKDGIHSSKGQGTQVTVSS

SEQ ID NO: 256 - protein, 114 aa, Artificial
  Nanobody sequence
EVQLVESGGDLVQPGGSLRLSCTAYGFIFDQARMFWARQAPGKGFEWLSSILTAGDTWYSDSVKGRFTISRDNAKNTLYLQMNDLKSEDTAVYYCSKDGIYSSKGQGTQVTVSS

SEQ ID NO: 257 - protein, 114 aa, Artificial
  Nanobody sequence
EVQLVESGGGLVQPGGSLRLSCTAYGFIFDQSRMFWARQAPGKGFEWLSSILTAGDTWYSDSVKGRFTISRDNAKNTLYLQMNDLKSEDTAVYYCSKDGIYSSKGQGTQVTVSS

SEQ ID NO: 258 - protein, 114 aa, Artificial
  Nanobody sequence
EVQLVESGGGLVQPGGSLRLSCTAYGFIFDQSRMFWARQAPGKGFEWLSSILTAGDTWHSDSVKGRFTISRDNAKNTLYLQMNDLKSEDTAVYYCSKDGIYSSKGQGTQVTVSS

SEQ ID NO: 259 - protein, 114 aa, Artificial
  Nanobody sequence
EVQMVESGGDLVQPGGSLRLSCTAYGFIFDQARMFWARQAPGKGFEWLSSILTAGDTWYSDSVKGRFTISRDNAKNTLYLQMNDLKSEDTAVYYCSKDGIYSSKGQGTQVTVSS

SEQ ID NO: 260 - protein, 114 aa, Artificial
  Nanobody sequence
EVQLVESGGDLVQPGGSLRLSCTAYGFIFDQARMFWARQAPGKGFEWLSSILTAGDTWYSDSVKGRFIISRDNAKNTLYLQMNDLKSEDTAVYYCSKDGIYSSKGQGTQVTVSS

SEQ ID NO: 261 - protein, 114 aa, Artificial
  Nanobody sequence
EVQLVESGGGLVQPGGSLRLSCTAYGFVFDQSRMFWARQAPGKGFEWLSSILTAGDTWYSDSVKGRFTISRDNAKNTLYLQMNDLKSEDTAVYYCSKDGIHSSKGRGTQVTVSS

SEQ ID NO: 262 - protein, 125 aa, Artificial
  Nanobody sequence
EVQLVESGGGLVQPGGSLRLSCEASGFTWDYYVIGWFRQAPGKEREGLSCISSDGSTTYADSVKGRFTISRDNAKNTVYLQMNSLKPEDTAVYYCATDPALGCYSGTYYPRYDYWGQGTQVTVSS

SEQ ID NO: 263 - protein, 126 aa, Artificial
  Nanobody sequence
EVQLVESGGGLVQPGGSLRLSCAASGLTLDYYALGWFRQAPGKEREGVSCISSVDHSTTYADSVKGRFTISWDNAKNTVYLQMNSLKPEDTAVYYCAADPALGCYSGSYYPRYDYWGQGTQVTVSS

SEQ ID NO: 264 - protein, 126 aa, Artificial
  Nanobody sequence
EVQPVESGGGLVQPGGSLRLSCEASGFTWDYYVIGWFRQAPGKEREGLSCISSSDGSTTYADSVKGRFTISRDNAKNTVYLQMNSLKPEDTAVYYCAVDPALGCYSGSYYPRYDYWGQGTQVTVSS

SEQ ID NO: 265 - protein, 126 aa, Artificial
  Nanobody sequence
EVQLVESGGGLVQPGGSLRLSCEASGFTWDYYVIGWFRQAPGKEREGLSCISSSDGSTTYADSVKGRFTISRDNAKNTVYLQMNSLKPEDTAVYYCAVDPALGCYSGSYYPRYDYWGQGTQVTVSS

SEQ ID NO: 266 - protein, 126 aa, Artificial
  Nanobody sequence
EVQLVESGGGLVQPGGSLRLSCAASGLTLDYYAIGWFRQAPGKEREGVSCISSSDHSTTYADSVKGRFTISWDNAKNTVYLQMNSLKPEDTAVYYCAADPALGCYSGSYYPRYDYYGQGTQVTVSS

SEQ ID NO: 267 - protein, 126 aa, Artificial
  Nanobody sequence
EVQLVESGGGLVQPGGSLRLSCAASGLTLDYYALGWFRQAPGKEREGVSCISSSDHSTTYTDSVKGRFTISWDNAKNTLYLQMNSLKPEDTAVYYCAADPALGCYSGSYYPRYDYWGQGTQVTVSS

SEQ ID NO: 268 - protein, 125 aa, Artificial
  Nanobody sequence
EVQLVESGGGLVQPGGSLRLSCEASGFTWDYYVIGWFRQAPGKEREGLSCISSDGSTTYADSVKGRFTISRDNAKNTVYLQMNSLKPEDTAVYYCATDPALGCYSGSYYPRYDYWGQGTQVTVSS

SEQ ID NO: 269 - protein, 126 aa, Artificial
  Nanobody sequence
EVQLVESGGGLVQPGGSLRLSCAASGLTLDYYAIGWFRQAPGKEREGVSCISSVDHSTTYADSVKGRFTISWDSAKNTVYLQMNDLKPEDTAVYYCAADPALGCYSGSYYPRYDYWGQGTQVTVSS

SEQ ID NO: 270 - protein, 126 aa, Artificial
  Nanobody sequence
EVQLVESGGGLVQPGGSLRLSCAASGFTSDYYAIGWFRQAPGKEREGVSCISSSDGSTTYADLVKGRFTISRDNAKNTVYLQMNSLQPEDTAVYYCAADPALGCYSGSYYPRYDYWGQGTQVTVSS

SEQ ID NO: 271 - protein, 125 aa, Artificial
  Nanobody sequence
EVQLVESGGGLVQPGGSLRLSCAASGFTWDYYVIGWFRQAPGKEREGVSCISSDGTTTYPDSVKGRFTISRDNAKNTVYLQMNSLKPEDTAVYYCAADPALGCYSGSYYPRYDYWGQGTQVTVSS

SEQ ID NO: 272 - protein, 126 aa, Artificial
  Nanobody sequence
EVQLVESGGGLVQPGGSLRLSCAASGFTWDYYAIGWFRQAPGKEREGVSCISSSDGSTTYADSVKGRFTISRDNAKNTVYLQMNSLTPEDTAVYYCAVDPALGCYSGSYYPRYDYWGQGTQVTVSS

SEQ ID NO: 273 - protein, 125 aa, Artificial
  Nanobody sequence
EVQLEESGGGLVQPGGSLRLSCEASGFTWDYYVIGWFRQAPGKEREGLSCISSDGLTTYADSVKGRFTISRDNAKNTVYLQMNGLKPEDTAVYYCATDPALGCYSGSYYPRYDYWGQGTQVTVSS

SEQ ID NO: 274 - protein, 126 aa, Artificial
  Nanobody sequence
EVQLVESGGGLVQPGGSLRLSCAASGLTLDYYALGWFRQAPGKEREGVSCISSADHSTTYADSVKGRFTISWDNAKNTVYLQMNSLKPEDTAVYYCAADPALGCYSGNYYPRYDYWGQGTQVTVSS

SEQ ID NO: 275 - protein, 126 aa, Artificial
  Nanobody sequence
EVQLVESGGGLVQPGGSLRLSCAASGLTLDYYALGWFRQAPGKEREGVSCISSADHSTTYADSVKGRFTISWDNAKNTVYLQMNSLKPEDTAVYYCAADPALGCYSGSYYPRYDYWGQGTQVTVSS

SEQ ID NO: 276 - protein, 126 aa, Artificial
  Nanobody sequence
EVQLVESGGGLVQPGGSLRLSCAASGFTWDYYVIGWFRQAPGKEREGVSCISSSDGSTTYADFVKGRFTISRDNAKNTVYLQMNSLTPEDTAVYYCAADPALGCYSGNYYPRYDYWGQGTQVTVSS

SEQ ID NO: 277 - protein, 125 aa, Artificial
  Nanobody sequence
EVQLVESGGGLVQPGGSVRLSCAASGFTWDYYVIGWFRQAPGKEREGLSCISSDGSTTYADSVKGRFTISRDNAKNTVYLQMNSLKPEDTAVYYCATDPALGCYSGSYYPRYDYWGQGTQVTVSS

SEQ ID NO: 278 - protein, 125 aa, Artificial
  Nanobody sequence
EVQLVESGGGLVQPGGSLRLSCEASGFTWDYYVIGWFRQAPGKEREGLSCISSDGSTTYADSVKGRFTISRDNAKNTVYLQMNSLEPEDTAVYYCATDPALGCYSGSYYPRYDYWGQGTQVTVSS

SEQ ID NO: 279 - protein, 126 aa, Artificial
  Nanobody sequence
EVQLVESGGGLVQPGGSLRLSCAASGLTLDYYALGWFRQAPGKEREGVSCISSVDHSTTYADSVKGRFTISWDNAKNMVYLQMNSLKPEDTAVYYCAADPALGCYSGNYYPRYDYWGQGTQVTVSS

SEQ ID NO: 280 - protein, 126 aa, Artificial
  Nanobody sequence
EVQLVESGGGLVQPGGSLRLSCAASGLTLDYYALGWFRQAPGKEREGVSCISSSDHSTTYADSVKGRFTISWDNAKNTVYLQMNSLKPEDTAVYYCAADPALGCYSGSYYPRYDYWGQGTQVTVSS

SEQ ID NO: 281 - protein, 126 aa, Artificial
  Nanobody sequence
EVQLVESGGGLVQPGGSLRLSCAASGLTLDYYAIGWFRQAPGKEREGVSCISSTDHSTTYADSVKGRFTISWDNAKKMVYLQMNKLKPEDTAVYYCAADPALGCYSGSYYPRYDYWGQGTQVTVSS

SEQ ID NO: 282 - protein, 126 aa, Artificial
  Nanobody sequence
EVQLVESGGGLVQPGGSLRLSCAASGLTLDYYALGWFRQAPGKEREGVSCISSSDHTTTYADSVKGRFTISWDNAKNTLYLQMNSLKPEDTAVYYCAADPALGCYSGSYYPRYDFWGQGTQVTVSS

SEQ ID NO: 283 - protein, 126 aa, Artificial
  Nanobody sequence
EVQLVESGGGLVQPGGSLRLSCAASGFTWDYYAIGWFRQAPGKEREGVSCISSSDGSTTYADSVKGRFTISRDNTKNTVYLQMNSLTPEDTAIYYCAVDPALGCYSGNYYPRYDYWGQGTQVTVSS

SEQ ID NO: 284 - protein, 126 aa, Artificial
  Nanobody sequence
EVQLVESGGGLVQPGGSLRLSCAASGLTLDYYALGWFRQAPGKEREGVACIDSSDHSTTYADSVKGRFTISWDNAKNTVYLQMSSLKPEDTAVYHCAADPALGCYSGSYYPRYDYWGQGTQVTVSS

SEQ ID NO: 285 - protein, 125 aa, Artificial
  Nanobody sequence
EVQLVESGGGLVQPGGSLRLSCEASGFTWDYYVIGWFRQAPGKEREGLSCISSDGSTTYADSVKGRFTISRDNAKNMVYLQMNSLKPEDTAVYYCATDPALGCYSGSYYPRYDYWGQGTQVTVSS

SEQ ID NO: 286 - protein, 126 aa, Artificial
  Nanobody sequence
EVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSS

SEQ ID NO: 287 - protein, 126 aa, Artificial
  Nanobody sequence
EVQLVESGGGLVQPGGSLRLSCAASGFTWDYYVIGWFRQAPGKEREGVSCISSSDGSTTYADFVKGRFTISRDNAKNTVYLQMNNLTPEDTAVYYCATDPALGCYSGNYYPRYDYWGQGTQVTVSS

SEQ ID NO: 288 - protein, 126 aa, Artificial
  Nanobody sequence
EVQLVESGGGLVQPGGSLRLSCAASGFTWDYYVIGWFRQAPGKEREGVSCISSSDGSTTYADFVKGRFTISRDNARNTVYLQMNNLTPEDTAVYYCATDPALGCYSGNYYPRYDYWGQGTQVTVSS

SEQ ID NO: 289 - protein, 126 aa, Artificial
  Nanobody sequence
EVQLVESGGGLVQPGGSLRLSCAASGLTLDYYALGWFRQAPGKEREGVSCISSVDHSTTYADSVKGRFTISWDNAKNIVYLQMNSLKPEDTAVYYCAADPALGCYSGSYYPRYDYWGQGTQVTVSS

SEQ ID NO: 290 - protein, 126 aa, Artificial
  Nanobody sequence
EVQLVESGGGLVQPGGSLRLSCAASGLTLDYYAIGWFRQAPGKEREGVSCISSVDHSTTYADPVKGRFTISWDSAKNTVYLQMNDLKPEDTAVYYCAADPALGCYSGSYYPRYDYWGQGTQVTVSS

SEQ ID NO: 291 - protein, 126 aa, Artificial
  Nanobody sequence
EVQLVESGGGLVQPGGSLRLSCAASGLTLDYYAIGWFRQAPGKEREGVSCISSSDHSTTYADSVKGRFTISWDNAKKVVYLQMNSLKPEDTAVYYCAADPALGCYSGSYYPRYDYWGQGTQVTVSS

SEQ ID NO: 292 - protein, 126 aa, Artificial
  Nanobody sequence
EVQLVESGGGLVQPGGSLRLSCAASGLTLDYYALGWFRQAPGKEREGVSCISSVDHSTTYADSVKGRFTISWDNAKNMVYLQMNSLKPEDTAVYYCAADPALGCYSGSYYPRYDYWGQGTQVTVSS

SEQ ID NO: 293 - protein, 125 aa, Artificial
  Nanobody sequence
EVQLVESGGGLVQPGGSLRLSCEASGFTWDYYVIGWFRQAPGKEREGLSCISSDGLTTYADSVKGRFTISRDNAKNTVYLQMNGLKPEDTAVYYCATDPALGCYSGSYYPRYDYWGQGTQVTVSS

SEQ ID NO: 294 - protein, 126 aa, Artificial
  Nanobody sequence
EVQLVESGGGLVQPGGSLRLSCAASGLTLDYYALGWFRQAPGKEREGVSCISSSDHSTTYADSVKGRFTISWDNAKNTLYLQMNSLKPEDTAVYYCAADPALGCYSGSYYPRYDYWGQGTQVTVSS

SEQ ID NO: 295 - protein, 126 aa, Artificial
  Nanobody sequence
EVQLVESGGGLVQPGGSLRLSCAASGLTLDYYALGWFRQAPGKEREGVSCISSVDHSTTYADSVKGQFTISWDNAKNMVYLQMNSLKPEDTAVYYCAADPALGCYSGSYYPRYDYWGQGTQVTVSS

SEQ ID NO: 296 - protein, 126 aa, Artificial
  Nanobody sequence
EVQLVESGGGLVQPGGSLRLSCVASGLTLDYYALGWFRQAPGKEREGVSCISSSDHSTTYADSVKGRFTISWDNAKNTVYLQMNSLKPEDTAVYYCAADPALGCYSGSYYPRYDYWGQGTQVTVSS

SEQ ID NO: 297 - protein, 126 aa, Artificial
  Nanobody sequence
EVQLVESGGGLVQPGGSLRLSCAASGFTWDYYAIGWFRQAPGKEREGVSCISSSDGSTTYADSVKGRFTISRDNTKNTVYLQMNSLTPEDTAVYYCAVDPALGCYSGNYYPRYDYWGQGTQVTVSS

SEQ ID NO: 298 - protein, 126 aa, Artificial; identical to SEQ ID NO: 282
  Nanobody sequence

SEQ ID NO: 299 - protein, 126 aa, Artificial
  Nanobody sequence
EVQLVESGGGLVQPGGSLRLSCAASGLTLDYYALGWFRQAPGKGREGVSCISSSDHTTTYADSVKGRFTISWDNAKNTLYLQMNSLKPEDTAVYYCAADPALGCYSGNYYPRYDFWGQGTQVTVSS

SEQ ID NO: 300 - protein, 126 aa, Artificial
  Nanobody sequence
EVQLVESGGGLVQPGGSLRLSCAASGLTLDYYALGWFRQAPGKEREGVSCISSSDHTTTYADSVKGRFTISWDNAKNTLYLQMNSLKPEDTAVYYCAADPALGCYSGNYYPRYDFWGQGTQVTVSS

SEQ ID NO: 301 - protein, 126 aa, Artificial
  Nanobody sequence
EVQLVESGGGLVQPGGSLRLSCAASGLTLDYYALGWFRQAPGKEREGVSCISSSDHTTTYTDSVKGRFTISWDNAKNTLYLQMNSLKPEDTAVYYCAADPALGCYSGSYYPRYDFWGQGTQVTVSS

SEQ ID NO: 302 - protein, 126 aa, Artificial
  Nanobody sequence
EVQLVESGGGLVQPGGSLRLSCAASGLTLDYYALGWFRQAPGKEREGVSCISSSDHTTTYADSVKGRFTISWDNAKNTLYLQMTSLKPEDTAVYYCAADPALGCYSGSYYPRYDFWGQGTQVTVSS

SEQ ID NO: 303 - protein, 126 aa, Artificial
  Nanobody sequence
EVQLMESGGGLVQPGGSLRLSCATSGFTLDYYVIGWFRQAPGKEREGVSCMSSSGDITTYAPSVKGRFTISRDNAKNMVYLQMTSLKPEDTAVYYCAADFALGCYSGSYVPRYDYWGQGTQVTVSS

SEQ ID NO: 304 - protein, 126 aa, Artificial
  Nanobody sequence
EVQLVESGGGLVQPGGSLRLSCATSGFTLDYYVIGWFRQAPGKEREGVSCMSSSGDSTTYADSVKGRFTISRDNAKNMVYLQMTSLKPEDTAVYYCAADFALGCYSGSYYPRYDYWGQGTQVTVSS

SEQ ID NO: 305 - protein, 126 aa, Artificial
  Nanobody sequence
EVQLVESRGGLVQPGGSLRLSCATSGFTLDYYVIGWFRQAPGKEREGVSCMSSSGDSTTYADSVKGRFTISRDTAKNMVYLQMTSLKPEDTAVYYCAADFALGCYSGSYYPRYDYWGQGTQVTVSS

SEQ ID NO: 306 - protein, 126 aa, Artificial
  Nanobody sequence
EVQLVESGGGLVRPGGSLRLSCATSGFTEDYYVIGWFRQAPGKEREGVSCMSSSGDSTTYADSVKGRFTISRDNAKNMVYLQMTSLKPEDTAVYYCAADFALGCYSGSYYPRYDYWGQGTQVTVSS

SEQ ID NO: 307 - protein, 126 aa, Artificial; identical to SEQ ID NO: 306
  Nanobody sequence

SEQ ID NO: 308 - protein, 126 aa, Artificial
  Nanobody sequence
EVQLVESGGGLVQPGGSLRLSCATSGFTEDYYVIGWFRQAPGKEREGVSCMSSSGDSTTYADSVKGRFTISRDNAKNMVYLQMTSLKPEDTAVYYCAADFALGCYSGSYYPRYDYWGQGTQVTVSS

SEQ ID NO: 309 - protein, 126 aa, Artificial
  Nanobody sequence
EVQLVESGGGLVQPGGSLRLSCATSGFTLDYYVIGWFRQAPGKEREGVSCMSSSGDSTTYADSVKGRFTISRDTAKNMVYLQMTSLKPEDTAVYYCAADFALGCYSGSYYPRYDYWGQGTQVTVSS

SEQ ID NO: 310 - protein, 126 aa, Artificial
  Nanobody sequence
EVQLVESGGGLVQPGGSLRLSCATSGLTLDYYVIGWFRQVPGKEREGVSCMSSSGDSTTYADSVKGRFTISRDNAKNMVYLQMTSLMPEDTAVYYCAADFALGCYSGSYYPRYDYWGQGTQVTVSS

SEQ ID NO: 311 - protein, 126 aa, Artificial
  Nanobody sequence
EVQLVESGGGLVQPGGSLRLSCATSGFTMDYYVIGWFRQAPGKEREGVSCMSSSGDSTTYAPSVKGRFTISRDNAKNMVYLQMTSLKPEDTAVYYCAADFALGCYSGSYYPRYDYWGQGTQVTVSS

SEQ ID NO: 312 - protein, 126 aa, Artificial
  Nanobody sequence
EVQLVESGGGLVQPGGSLTLSCATSGLTLDYYVIGWFRQAPGKEREGVSCMSSSGDSTTYADSVKGRFTISRDNAKNMVYLQMTSLKPEDTAIYYCAADFALGCYSGSYYPRYDYWGQGTQVTVSS

SEQ ID NO: 313 - protein, 126 aa, Artificial
  Nanobody sequence
EVQLVESGGGLVQPGGSLRLSCATSGFTEDYYVIGWFRQAPGKEREGVSCMSSSGDSTTYADSVQGRFTISRDNAKNMVYLQMTSLKPEDTAVYYCAADFALGCYSGSYYPRYDYWGQGTQVTVSS

SEQ ID NO: 314 - protein, 126 aa, Artificial
  Nanobody sequence
EVQLVESGGGLVQPGGSLRLSCATSGFTLDYYVIGWFRQAPGKEREGVSCMSSSGDITTYAPSVKGRFTISRDNAKNMVYLQMTSLKPEDTAVYYCAADFALGCYSGSYVPRYDYWGQGTQVTVSS

SEQ ID NO: 315 - protein, 126 aa, Artificial
  Nanobody sequence
EVQLVESGGGLVQPGGSLRLSCATSGFTLDYYVIGWFRQAPGKEREGVSCMSSSGDITTYAPSVKGRFTISRDNAKNMVYLQMTSLKPEDTAVYYCAADFPLGCYSGSYVPRYDYWGQGTQVTVSS

SEQ ID NO: 316 - protein, 133 aa, Artificial
  Nanobody sequence
EVQLVESGGGLVQAGGSLRLSCAASGFTFDDYAIGWFRQAPGKEREAVSCISSSDGTTYYADSVKGRFTISSDNAKNTVYLTMNNLKPEDTAVYYCAADRLSTVVGCLYYGGSYYPRTTIDYWGKGTLVTVSS

SEQ ID NO: 317 - protein, 133 aa, Artificial
  Nanobody sequence
EVQLVESGGGLVQAGGSLRLSCAASGFTFDDYAIGWFRQAPGKEREAVSCISSSDGSTYYTDSVKGRFTISSDNAKNTVYLTMNSLKPEDTAVYYCAADLLSTVVGCLYYRGSYYPRTTADYWGKGTLVTVSS

SEQ ID NO: 318 - protein, 133 aa, Artificial
  Nanobody sequence
EVQLVESGGGLVQAGGSLRLSCAASGFTFDDYAIGWFRQAPGKEREAVSCISSSDGSTYYADSVKGRFTISSDNAKNMVYLQMNSLKPEDTAVYYCAADLLRTAVGCLDYRGTYYPRTTMDYRGKGTLVTVSS

SEQ ID NO: 319 - protein, 133 aa, Artificial
  Nanobody sequence
EVQLVESGGGLVQAGGSLRLSCAASGFTFDDYAIGWFRQAPGKEREAVSCISSSDSSTYYTDSVKGRFTISSDNAKNTVYLTMNSLKPEDTAVYYCAADLLSTVVGCLYYRGSYYPRTTADYWGKGTLVTVSS

SEQ ID NO: 320 - protein, 133 aa, Artificial
  Nanobody sequence
EVQLVESGGGLVQAGGSLRLSCAASGFTFDDYAIGWFRQAPGKEREAVSCISSSDGVTYYSDSVKGRFTISSDNAKNTVYLQMNSLKPEDTAVYYCAADLLRTAVGCLYYRGTYYPRTTMDYRGKGTLVTVSS

SEQ ID NO: 321 - protein, 133 aa, Artificial
  Nanobody sequence
EVQLVESGGGLVQAGGSLRLSCAASGFTFDDYAIGWFRQAPGKEREAVSCISSSDGSTYYTDSVKGRFTISSDNAKNTVYLTMNSLKPEDTAVYYCAADQLSTVVGCFYYRGSYYPRTTADYWGKGTLVTVSS

SEQ ID NO: 322 - protein, 133 aa, Artificial
  Nanobody sequence
EVQLVESGGGLVQAGGSLRLSCAASGLTFDDYAIGWFRQAPGKEREAVSCISSSDGSTYYADSVKGRFTISRDNAKNTVYLQMNSLKPEDTAVYYCAADLLATAVGCLYYRGTYYPRTTMDYWGKGTLVTVSS

SEQ ID NO: 323 - protein, 133 aa, Artificial
  Nanobody sequence
EVQLVESGGGLVQAGGSLRLSCAASGFTFDDYAIGWFRQAPGKEREAVSCISSSDGTTYYADSVKGRFTISSDNAKNTVYLAMNNLKPGDTAVYYCAADLLSTVVGCLYYGGSYYPRTTIDYWGKGTLVTVSS

SEQ ID NO: 324 - protein, 133 aa, Artificial
  Nanobody sequence
EVQLVESGGGLVQAGGSLRLSCAASGFTFDDYAIGWFRQAPGKEREGVSCIDSSDGSTYYADSVKGRFTISSDNAKNTVYLQMNSLKPEDTAVYYCAADLLRTVVGCLYYGGRYSPRTTTDYWGKGTLVTVSS

SEQ ID NO: 325 - protein, 133 aa, Artificial
  Nanobody sequence
EVQLVESGGGLVQAGGSLRLSCAASGFTFDDYAIGWFRQAPGKEREAVSCISSSDGTTYYADSVKGRFTISSDNAKNTVYLTMNNLKPEDTAVYYCAADLLSTVVGCLYYGGSYYPRTTIDYWGKGTLVTVSS

SEQ ID NO: 326 - protein, 132 aa, Artificial
  Nanobody sequence
EVQLVESGGGLVQAGGSLRLSCAASGFTFDDYAIGWFRQAPGKEREAVSCISSSDGTYYADSVKGRFTISSDNAKNTVYLQMNSLKPEDTAVYYCAADLLRTAVGCLHYRGSYYPRTTIDYWGKGTLVTVSS

SEQ ID NO: 327 - protein, 133 aa, Artificial
  Nanobody sequence
EVQLVESGGGKVQPGGSLRLSCAASGFTFDDYAIGWFRQAPGKEREGVSCIDSSDGSTYYADSVKGRFTISKDNAKNTVYLQMNSLKPEDTAVYYCAADLLRTVVGCLYYGGSYSPRTTMDYWGKGTLVTVSS

SEQ ID NO: 328 - protein, 122 aa, Artificial
  Nanobody sequence
EVQLVESGGGLVQAGGSLRLSCAASGRTFSSYAMGWFRQAPGKEREFVGAISGSGSNIYYANSMPGRITIFRDNAKNTAYLQMNSLNPEDTAVYYCAAAPTLVEITTTPTYWGQGTQVTVSS

SEQ ID NO: 329 - protein, 122 aa, Artificial
  Nanobody sequence
EVQLVQSGGGLVQAGGSLRLSCAASGRTFSSYAMGWFRQAPGKEREFVGAISGSGSNIYYANAMPGRITIFRDNAKNTVYLQMNSLNPEDTAVYYCAAAPTLVEITPTPTYWGQGTQVTVSS

SEQ ID NO: 330 - protein, 122 aa, Artificial
  Nanobody sequence
EVQLVESGGGLVQAGGSLRLSCAASGRTFSSYAMGWFRQAPGKEREFVGAISGSGSNIYYADSMPGRITIFRDNAKNTVYLQMNSLNPEDTAVYYCAAAPTLVEITPTPTYWGQGTQVTVSS

SEQ ID NO: 331 - protein, 122 aa, Artificial
  Nanobody sequence
EVQLVESGGGLVQAGGSLRLSCAASGRTFSSYAMGWFRQAPGKEREFVGAISESGSNIYYANAMPGRITIFRDNAKNTAYLQMNSLNPEDTAVYYCAAAPTLVEITTTPTYWGQGTQVTVSS

SEQ ID NO: 332 - protein, 122 aa, Artificial
  Nanobody sequence
EVQLVESGGGLVQAGGSLRLSCAASGRTFSSYAMGWFRQAPGKEREFVGAISGSGSNIYYANSMPGRITIFRDNAKNTVYLQMNSLNPEDTAVYYCAAAPTLVEITPTPTYWGRGTRVTVSS

SEQ ID NO: 333 - protein, 123 aa, Artificial
  Nanobody sequence
EVQLVESGGGLVQAGGSLRLSCADHGRTLAYYTAGWFRQAPGKEREFVASISRSSGSTRYADSVRGRFTISRDNAKNTVYLQMNSLKPEDTAAYYCATTDDYINTTPALYRNWGQGTQVTVSS

SEQ ID NO: 334 - protein, 122 aa, Artificial
  Nanobody sequence
EVQLVESGGGLVQAGDSLRLSCTASERTFRNDAGGWFRQAPGKEREFVAAITSGGSTDYANSVKGRFTISRDNAKNTVYLQMNSLRPEDTAVYYCAADSNVNTVKLGWGRYWGQGTQVTVSS

SEQ ID NO: 335 - protein, 122 aa, Artificial
  Nanobody sequence
EVQLVESGGGLVQAGDSLRLSCTASERTFGNDAGGWFRQAPGKERDFVAAITSGGSTDYANSVKGRFTISRDNAKNTVYLQMNSLRPEDTAVYYCAADSSVNTVKLGWGRYWGQGTQVTVSS

SEQ ID NO: 336 - protein, 122 aa, Artificial
  Nanobody sequence
EVQLVESGGGLVQAGDSLRLSCTASERTFGNDAGGWFRQAPGKERDFVAAITSGGSTDYANSVKGRFTISRDNAKNTVYLQMNSLRPEDTAVYYCAADSNVNTVKLGWGRYWGQGTQVTVSS

SEQ ID NO: 337 - protein, 122 aa, Artificial
  Nanobody sequence
EVQLVESGGGLVHPGGSLRLSCAASERTFGNDAGGWFRQAPGKERDFVAAITSGGSTDYANSVKGRFTISRDNAKNTVYLQMNSLRPEDTAVYYCAADSNVNTVKLGWGRYWGQGTQVTVSS

SEQ ID NO: 338 - protein, 123 aa, Artificial
  Nanobody sequence
EVQLVESGGGLVQPGGSLRLSCAASGSIWSITSMGWYRQAAGKQRELVAKIISGGSTNYADSVKGRFTISRDNAKNTVYLQMNSLKPEDTAVYYCNADVRVAEKHTAYEANYWGQGTQVTVSS

SEQ ID NO: 339 - protein, 118 aa, Artificial
  Nanobody sequence
EVQLVESGGGLVQPGGSLSVSCAASGTIFAINAMGWYRQVPGKERELVAVMRNPGGTNYADSVKGRFTISRDNAKNTVYLQMNSLKPEDTAVYYCYLKMYGGNWYTYWGQGTQVTVSS

SEQ ID NO: 340 - protein, 128 aa, Artificial
  Nanobody sequence
EVQLVESGGGLVQAGASLRLSCAASGLAFSRYAMGWFRQAPGKERESVAAISSSGDNIYYADSVKGQFTMSRDNAKSSVYLQMINLKPEDTAVYYCAAATSPLFVASDYFDASRYDYWGQGTQVTVSS

SEQ ID NO: 341 - protein, 128 aa, Artificial
  Nanobody sequence
EVQLVESGGGLVHAGASLRLSCVASGLAFSRYAMGWFRQAPGKERESVAAISSSGDNIYYSRSVKGILSISRDNAKSAVYLQMNNLKPEDTAVYYCAAAASTLFIASDYFEASRYDYWGQGTQVTVSS

SEQ ID NO: 342 - protein, 127 aa, Artificial
  Nanobody sequence
EVQLVESGGGLVQAGASLRLSCAASGLAFSRYAMGWFRQAPGKERESVAAISSSGDNIYYADSVKGQFTMSRDNAKSSVYLQMINLKPEDTAVYYCAATSPLFVASDYFEASRYGYWGQGTQVTVSS

SEQ ID NO: 343 - protein, 127 aa, Artificial
  Nanobody sequence
EVQLVESGGGLVQAGASLRLSCAASGLAFSRYAMGWFRQAPGKERESVAAISSSGDNIYYPDSVKGQFTMSRDNAKSSVYLQMINLKPEDTAVYYCAAASPLFVASDYFEASRYGYWGQGTQVTVSS

SEQ ID NO: 344 - protein, 128 aa, Artificial
  Nanobody sequence
EVQLVESGGGLVHAGASLRLSCVASGLAFSRYAMGWFRQAPGKERESVAAISSSGDNIYYSRSVKGILSISRDNAKSAVYLQMNNLKPEDTAVYYCAAAASTLFVASDYFEASRYDYWGQGTQVTVSS

SEQ ID NO: 345 - protein, 127 aa, Artificial
  Nanobody sequence
EVQLVESGGGLVQAGASLRLSCAASGLAFSRYAMGWFRQAPGKERESVAAISSSGDNIYYADSVKGQFTMSRDNAKSSVYLQMINLEPEDTAVYYCAATSPLFVASDYFEASRYGYWGQGTQVTVSS

SEQ ID NO: 346 - protein, 124 aa, Artificial
  Nanobody sequence
EVQLVESGGGLVQAGGSLRLSCAASVGTFSNYDIGWFRQAPGKGREFVARISSAGSNLYYGSSMPGRITISRDNAKNTVYLQMNSLKPEDTAIYYCAADNTAYGSFKADDYDYWGQGTQVTVSS

SEQ ID NO: 347 - protein, 124 aa, Artificial
  Nanobody sequence
EVQLVESGGGLVQPGGSLRLSCAASAGTFSNYDIGWFRQAPGKGREFVARISSGGSNIYYGNSMPGRITISRDNAKNTVYLQMNSLTPEDTAIYYCAADSTAYGSFKADDYDYWGQGTQVTVSS

SEQ ID NO: 348 - protein, 124 aa, Artificial
  Nanobody sequence
EVQLVESGGGLVQPGGSLRLSCAASAGTLSNYDIGWFRQAPGKGREFVARISSAGSNLYYGTSMPGRITISRDNAKNTVYLQMNSLKPEDTAIYYCAADSTAYGSFKADDYDYWGQGTQVTVSS

SEQ ID NO: 349 - protein, 128 aa, Artificial
  Nanobody sequence
EVQLVESGGGLVQPGGSLRLSCAASGFTLDYYAIGWFRQAPGKEREGVSCISSWDGSTYYADSVKGRFTISRDNAKNTVYLQMNSLKPEDTAVYYCATDLTDSLCSYYDYMRPENDYWGQGTQVTVSS

SEQ ID NO: 350 - protein, 128 aa, Artificial
  Nanobody sequence
EVQLVESGGGLVQPGESLRLSCAASGFTLAYYAIGWFRQAPGKEREGVSCISSWDGSTYYADSVKGRFTISRDNAKNTVYLQMNSLKPEDTAVYYCATDLTDSLCSYYHYMRPENDYWGQGTQVTVSS

SEQ ID NO: 351 - protein, 128 aa, Artificial
  Nanobody sequence
EVQLVESGGGLVQAGGSLRLSCAASGRTFSRYIMGWFRQAPGKEREFVGAISRSGDITSFADFVKGRFTMSRDNAKNTLYLQMNSLEPEDTAVYSCAANSDTYYIYSDIVVPERYDYWGQGTQVTVSS

SEQ ID NO: 352 - protein, 121 aa, Artificial
  Nanobody sequence
EVQLVESGGGLVQAGDSLRLSCAASGRSFSSRAMGWFRQAPGKEREFVAAINWIGNIPYYANSVKGRFTISRDNAKNTVYLQMNSLKPDDTAVYYCATGSEPYYTNTYDYWGQGTQVTVSS

SEQ ID NO: 353 - protein, 127 aa, Artificial
  Nanobody sequence
EVQLVESGGGLVQAGGSLRLSCGSSGRTFSRYAMGWFRQAPGKEREFVAAISWSGGSTYYADSVKGRFTISRDNAKNTVYLQMNSLKPEDTAVYYCAADISSGNSGSYIYTWAYDYWGQGTQVTVSS

SEQ ID NO: 354 - protein, 127 aa, Artificial
  Nanobody sequence
EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSS

SEQ ID NO: 355 - protein, 127 aa, Artificial
  Nanobody sequence
EVQLVESGGGLVQAGGSLRLSCGSSGRTFSRYAMGWFRQAPGKEREFVAAISWSGGSTYYADSVKGRFTISRDNAKNTVYLQMSSLKPEDTAVYYCAADISSGNSGSYIYTWAYDYWGQGTQVTVSS

SEQ ID NO: 356 - protein, 127 aa, Artificial
  Nanobody sequence
EVQLVESRGGLVQAGGSLRLSCGSSGRTFSRYAMGWFRQAPGKEREFVAAISWSGGSTYYADSVKGRFTISRDNAKNTVYLQMNSLKPEDTAVYYCAADISSGNSGSYIYTWAYDYWGQGTQVTVSS

SEQ ID NO: 357 - protein, 127 aa, Artificial
  Nanobody sequence
EVQLVESGGGLVQAGGSLRLSCGSSGRTFSRYAMGWFRQAPGKEHEFVAAISWSGGSTYYADSVKGRFTISRDNAKNTVYLQMNSLKPEDTAVYYCAADISSGNSGSYIYTWAYDYWGQGTQVTVSS

SEQ ID NO: 358 - protein, 121 aa, Artificial
  Nanobody sequence
EVQLVESGGGWVQAGGSLRLSCAASGRAFSSYAMGWIRQAPGKEREFVAGIDQSGESTAYGTSASGRFIISRDNAKNTVYLLMNSLQSDDTAVYYCVADGVLATTLNWDYWGQGTQVTVSS

SEQ ID NO: 359 - protein, 121 aa, Artificial
  Nanobody sequence
EVQLVESGGGWVQAGGSLRLSCAASGRAFSSYAMGWIRQAPGKEREFVAGIDQSGESTAYGASASGRFIISRDNAKNTVHLLMNSLQSDDTAVYYCVADGVLATTLNWDYWGQGTQVTVSS

SEQ ID NO: 360 - protein, 124 aa, Artificial
  Nanobody sequence
EVQLVESGGGLVQAGGSLRLSCAASGRTFSSYTMGWFRQAPGKEREFVAAIHWSGSNIYYGNSMKGRLTVSRDNAKNTAYLQMNSLKPEDTAVYYCAAALLGENLQWKGAYDYWGQGTQVTVSS

SEQ ID NO: 361 - protein, 126 aa, Artificial
  Nanobody sequence
EVQLVESGGGLVQAGGSLRLSCVASGLTFEHYYMGWYRQAPKKEREFVADISRAGASRYADSVKGRFTISRDNAKNTVYLQMNSLESEDTAVYYCAADYSHTFVYPSMVPYESDYWGQGTQVTVSS

SEQ ID NO: 362 - protein, 124 aa, Artificial
  Nanobody sequence
EVQLVESGGGLVQPGGSLRLSCSASGFTFSVYAMNWVRQAPGKGLEWVSGISFSGGATMYADSVKGRFTISRDNAKNTLYLQMNSLKPEDTGVYYCAKGMSPNIEYAQGPVAYRGQGTQVTVSS

SEQ ID NO: 363 - protein, 128 aa, Artificial
  Nanobody sequence
EVQLVESGGGLVQAGGSLRLSCVASGRSFSNYPMGWFRQAPGKEREFVGAISGSGSNLYYPGSWKGRFTISRDNAKNTGYLQMNSLKPEDTAVYYCALDHKASGSYSSLSRPEEYDYWGQGTQVTVSS

SEQ ID NO: 364 - protein, 128 aa, Artificial
  Nanobody sequence
EVQLVESGGGLVQAGGSLRLSCAASGLTLDDYAIGWFRQGPGKAREGVSCISSSDGSTYYADSVKGRFTMFSDNAKNTVALQMNSLKPEDTAVYYCTVLFGTSSCTYYSRRKYEYDYWGQGTQVTVSS

SEQ ID NO: 365 - protein, 123 aa, Artificial
  Nanobody sequence
EVQLMESGGGLVQAGGSLRLSCAASGGTFSSYAMGWFRQAPGEERDFVAAIGWSGNSPYYAQFVKGRFTISRDNAKNTVHLQMNSLKPEDTAVYYCAAAHNTMGSDYEGYDYWGQGTQVTVSS

SEQ ID NO: 366 - protein, 130 aa, Artificial
  Nanobody sequence
EVQLVESGGGLVQAGGSLRLSCAASGFTFDDYAIGWFRQAPGKEREGVSCISNSDGSTYYADSVKGRFTISSDNAKNTVYLQMNSLKPEDTAVYYCAASRRGGSRWYGLSGSCYYGMDYWGKGTLVTVSS

SEQ ID NO: 367 - protein, 124 aa, Artificial
  Nanobody sequence
EVQLVESGGGLVQPGGSLRLSCAASGFTFGNYAMYWVRQAPGKGLEWVSAINSGGGSTGYTDSVKGRFTISRDNAKNTLYLQMNSLKPEDTAVYYCAKDPYGSSWYGSPVYDYWGQGTQVTVSS

SEQ ID NO: 368 - protein, 128 aa, Artificial
  Nanobody sequence
EVQLVESGGGLVQAGGSLRLSCAASGFAVDDYAIGWFRQAPGKEREGVSSISSSDGSPYYADSVKGRFTISSDNAKNTVYLQMNSLKPEDTAVYYCAAGRSLYAKGSWWLISSEYDYWGQGTQVTVSS

SEQ ID NO: 369 - protein, 118 aa, Artificial
  Nanobody sequence
EVQLVESGGGLVQPGGSLRLSCAASGSDFGISVMGWYRQAPEKRRELVATITTFGITNYADSVKGRFTVSRDNAQNTVYLQMNSLKPDDTAVYYCYVRWYSSMWYEYWGQGTQVTVSS

SEQ ID NO: 370 - protein, 127 aa, Artificial
  Nanobody sequence
EVQLVESGGGLVQAGGSLRLSCAASGRTVSSSTMGWFRRAPGKEREFVAAISWNGGTHYADYFVKGRFTLSRDNAKNTVYLQMNSLKPEDTAVYYCAAPISSYVGGNYYSAAFYHYWGQGTQVTVSS

SEQ ID NO: 371 - protein, 126 aa, Artificial
  Nanobody sequence
EVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSS

SEQ ID NO: 372 - protein, 126 aa, Artificial
  Nanobody sequence
EVQLVESGGGLVQAGGSLSISCAASGGSLSNYVLGWFRQAPGKEREFVAAINWRGDITIGPPNVEGRFTISKDNAKNTGYLQMNSLAPDDTAVYYCGADTPLNPGAYIYDWSYDYWGRGTQVTVSS

SEQ ID NO: 373 - protein, 131 aa, Artificial
  Nanobody sequence
EVQLAESGGGLVQPGGSLRLSCAASGFTFEYYAMGWFRQAPGKEREGVSCISSSDGSTYYADSVKGRFTISRDNAKNTVYLQMNSLKPEDTAVYYCAADHSRVYYRDYRQGRLCEEPYDYWGQGTQVTVSS

SEQ ID NO: 374 - protein, 128 aa, Artificial
  Nanobody sequence
EVQLVESGGGLVQAGGSLRLSCTASARRFSTSTMGWFRQAPGNEREFVACISWSGDITFYADSVKGRFTISRDNAKNAVYLQMNSLKPEDSAVYYCAFDARPAPYITNYKDPRAYDYWGQGTQVTVSS

SEQ ID NO: 375 - protein, 128 aa, Artificial
  Nanobody sequence
EVQLVESGGGLVQAGASLRLSCAASGRMFSSYGMGWFRQAPGKEREFVAAITWSGGYTYYLDSVKGRFTVSRDNAKNMVYLQMNSLKPEDTAVYYCAAGFQYYSTITNYARERDYDYWGQGTQVTVSS

SEQ ID NO: 376 - protein, 123 aa, Artificial
  Nanobody sequence
EVQLVESGGGLVQPGGSLRLSCVASGLTFSRYDMGWFRQAPGEERKFVAGINWSGGRTYYADSVKGRFTISRDNAKETVSLQMSGLKPEDTAVYYCAADQPPSTWLVEYFDYWGQGTRVTVSS

SEQ ID NO: 377 - protein, 123 aa, Artificial
  Nanobody sequence
EVQLVESGGGLVQAGGSLRLSCAASGLTFSRYDMGWFRQAPGEERQFVAGINWSGGRTYYADSVKGRFTISRDNAKEIVSLQMSGLKPEDTAVYYCAADQPPSTWLAEYFDYWGQGTRVTVSS

SEQ ID NO: 378 - protein, 123 aa, Artificial
  Nanobody sequence
EVQLVESGGGLVQAGGSLRLSCAASGLTFSRYDMGWFRQAPGEERKFVAGINWSGGRTYYADSVKGRFTISRDNAKETVSLQMSGLKPEDTAVYYCAADQPPSTWLVEYFDYWGQGTRVTVSS

SEQ ID NO: 379 - protein, 123 aa, Artificial
  Nanobody sequence
EVQLVESGGGLVQPGGSLRLSCAASGLTFSRYDMGWFRQAPGKEREFVAGINWSGGRTYYADSVKGRFTISRDNAKETVSLQMNGLKPEDTAVYYCAADQPPSTWLVEYFDYWGQGTQVTVSS

SEQ ID NO: 380 - protein, 127 aa, Artificial
  Nanobody sequence
EVQLVESGGGLVQPGGSLRLSCAASGRTFSSIAMGWFRQAPGKEREFVAAISWSRGRTFYADSVKGRFIISRDDAANTAYLQMNSLKPEDTAVYYCAVDTASWNSGSFIYDWAYDHWGQGTQVTVSS

SEQ ID NO: 381 - protein, 126 aa, Artificial
  Nanobody sequence
EVQLVESGGGLVQAGGSLKLSCAASGRAFSSYTMGWFRQAPGKEREFVACVSRDGGTTYYAYSVKGRFTISRDNAKNTVYLQMNSLGPEDTAIYTCAAKENGMFITATQEQSYDYWGQGTQVTVSS

SEQ ID NO: 382 - protein, 126 aa, Artificial
  Nanobody sequence
EVQLVESGGGLVQAGGSLRLSCAASGRTFSSSFMAWFRQVLGSDREFVGGISPGGRFTYYADSRKGRFTISEDNANNTVYLQMHSVKPEDTATYYCAADTQFSGYVPKETNEYDYWGQGTQVTVSS

SEQ ID NO: 383 - protein, 123 aa, Artificial
  Nanobody sequence
EVQLVESGGGLVQPGGSLRLSCAASGFTFRNYAIGWFRQVPGKEREGVSCINSGGGRIDYADSVKGRFAISRDNAKSTVYLQMNSLKPEDTAVYYCAIDYTSSCPIYSGTDYWGKGTLVTVSS

SEQ ID NO: 384 - protein, 129 aa, Artificial
  Nanobody sequence
EVQLVESGGGLVQAGGSLRLSCAASGFTFDDYAIGWFRQAPGKEREGVSCIRCNDGSTYYADSVKGRFTISSDNAKNTVYLQMNSLKPEDTAVYYCAADFSLAQYKTIHTMPPYAMDYWGKGTLVTVSS

SEQ ID NO: 385 - protein, 127 aa, Artificial
  Nanobody sequence
EVQLVESGGGLVQAGGSLRLSCAASGPTFSSYTMGWFRQAPGKEREFVATIPWSGGIPYYSDSVKGRFTMSSDNAKNTVDLQMNSLKPEDTALYYCAGSSRIYVYSDSLSEGSYDYWGRGTQVTVSS

SEQ ID NO: 386 - protein, 126 aa, Artificial
  Nanobody sequence
EVQLVESGGGLVQAGGSLRLSCVASGRTFNNLAMGWFRQARGKEREFVATISWSHPNTYYTDSVKGRFTISRDDAQNAVYLQMNSLKPEDTAVYYCAANPSYVYSDYLSLAGYTYWGQGTQVTVSS

SEQ ID NO: 387 - protein, 127 aa, Artificial
  Nanobody sequence
EVQLVESGGGLVQPGGSLRLSCEASGFTFSSYWMYWVRQVPGKGLEWVSAISTGGGDTHYQDSVKGRFTISRDNAKNTLYLQMSSLKPEDTALYYCARNRDSGTSYITFSLTDFASWGQGTQVTVSS

SEQ ID NO: 388 - protein, 125 aa, Artificial
  Nanobody sequence
EVQLVESGGGLVQAGDSLRLSCAASGLTFSTYVMAWFRQAPGKERECVAAINWSGENIYYADSVKGRFTISRDNAKNTVYLQMNSLKPEDTADYLCAARKYYIHSDVVGNDYPYWGQGTQVTVSS

SEQ ID NO: 389 - protein, 129 aa, Artificial
  Nanobody sequence
EVQLVESGGGLVQAGGSLRLSCAASERTFSYYAMGWFRQAPGKEREFVATISRSGEWIYYKDAMKGRFTISRDNANNAVYLQMNSLQPEDTAIYYCAADSLGGFRSASDYYNTNTYAYWGQGTQVTVSS

SEQ ID NO: 390 - protein, 126 aa, Artificial
  Nanobody sequence
EVQLVESGGGLVQPGGSLRLSCAASGFTLDYYAIGWFRQAPGKEREGVSCFPSRYSSDGSTYYADSVKGRFTISRDNAKNTVYLQMNSLKPEDAAVYYCAADPSDWTCNVLEYDYWGQGTQVTVSS

SEQ ID NO: 391 - protein, 114 aa, Artificial
  Nanobody sequence
EVQLVESGGGLVQPGGSLKLSCAGSGSIFRFYDTAGWYRQAPGKQRELVALITDISGGYIKYADSVKGRFTISRDNAKNTVYLQMNSLKPEDTAVYYCNVHNYWGQGTQVTVSS

SEQ ID NO: 392 - protein, 127 aa, Artificial
  Nanobody sequence
EVQLVESGGGLVQAGGSPRLSCAASGGTFSSYGMGWFRQAPGKEREFVAAISWSDSSTYYADSVKGRFTISRDNAKNTMYLQMNSLKPEDTAVYYCAAGSGILNSGSYYYPWVYEYWGQGTQVTVSS

SEQ ID NO: 393 - protein, 126 aa, Artificial
  Nanobody sequence
EVQLVESGGGLVQAGGSLRLSCASSGSIYSINFMNWYRQAPGKQRELVASITSGGYTNYADSVKGRFTISRDNAKNTVYLQMNSLKPEDTAVYICNAEGLIIATMDGGVNNDMDYWGKGTLVTVSS

SEQ ID NO: 394 - protein, 115 aa, Artificial
  Nanobody sequence
EVQLVESGGGLVQPGGSLRLSCAASGNIFSIATMAWYRQAPGKQRELVASISSSGYRIYADSVKGRFTSSRDNAKNTAYLQMNSLGPEDTAVYYCNFRDYEGNHWGQGTQVTVSS

SEQ ID NO: 395 - protein, 123 aa, Artificial
  Nanobody sequence
EVQLVESGGGLVQAGDSLRLSCAASGLTFSGYEMGWFRQAPGRERAFVAAISQSGGTTSYAVSVKGRFTIARDNAKNTVYLQANNMKPEDTAVYYCAAALLLLPTTPSRVDYWGQGTQVTVSS

SEQ ID NO: 396 - protein, 123 aa, Artificial
  Nanobody sequence
EVQLVESGGGLVQVGDSLRLSCAASGLTFSGYEMGWFRQAPGKERAFVAAISQSGGTTSYAVSVKGRFTIARDNAKNTVYLQANNMKPEDTAVYYCAAALLLLPTTPSRVDYWGQGTQVTVSS

SEQ ID NO: 397 - protein, 123 aa, Artificial
  Nanobody sequence
EVQLVESGGGLVQAGDSLRLSCAASGLTFSGYEMGWFRQAPGKERAFVAAISQSGGTTSYAVSVKGRFTITRDNAKNTVYLQANNMKPEDTAVYYCAAALLLLPTTPSRVDYWGQGTQVTVSS

SEQ ID NO: 398 - protein, 123 aa, Artificial
  Nanobody sequence
EVQLVESGGGLVQAGDSLRLSCAASGLTFSGYEMGWFRQAPGKERAFVAAISQSGGTTSYAVSVKGRFTIARDNAKNTVYLQADNMKPEDTAVYYCAAALLLLPTSPSRVDYWGQGTQVTVSS

SEQ ID NO: 399 - protein, 123 aa, Artificial
  Nanobody sequence
EVQLVESGGGLVQAGDSLRLSCAASGLTFSGYEMGWFRQAPGKERAFVAAISQSGGTTSYAVSVKGRFTIARDNAKNTVYLQANNMKPEDTAVYYCAAALLLLPTTPSRVDYWGQGTQVTVSS

SEQ ID NO: 400 - protein, 126 aa, Artificial
  Nanobody sequence
EVQLVESGGGLVQPGGSLRLSCAASGFAFSTYAMGWVRQAPGKGLEWVSCISNGGLRTMYADSVKGRFTISRDNAKNTLYLQMNSLKAEDTAVYYCAKYWAPWPMDVSRLDDYDNKGQGTQVTVSS

SEQ ID NO: 401 - protein, 128 aa, Artificial
  Nanobody sequence
EVQLVESGGGLVQAGGSLRLSCEASGRTFSSNAMGWFRQAPGKEREFVAAVTRWSGARTVYADSVKGRFTISRDNAENTVYLQMNSLKPEDTAVYTCAADSTNRNSGAIYYPWAYDYWGQGTQVTVSS

SEQ ID NO: 402 - protein, 128 aa, Artificial
  Nanobody sequence
EVQLVESGGGLVQAGGSLRLSCEASGRTFSSYDMGWFRQAPGKEREFVAAVTRWSGARGVYADSVKGRFTISRDNAENTVHLQMNSLKPEDTAVYTCAADSTNRNSGAVYYTWAYDYWGQGTQVTVSS

SEQ ID NO: 403 - protein, 128 aa, Artificial
  Nanobody sequence
EVQLVESGGGLVQAGGSLRLSCEASGRTFSNYAMGWFRQAPGKEREFVAVVSRWSGGRTLYADSVKGRFTISRDNAENLVYLQMNSLKPEDTAVYTCVADSTNRNSGAYYYTWAYDHWGQGTQVTVSS

SEQ ID NO: 404 - protein, 127 aa, Artificial
  Nanobody sequence
EVQLVESGGGLVQAGGSLRLSCAASGRTFSSYAMGWFRQAPGKEREFVAAIWWSGGSTYYADSVKGRFTMSRDNAKNTVYLEMNNLKPEDTAVYYCAADTDSSNSGSYLYTWAYDYWGQGTQVTVSS

SEQ ID NO: 405 - protein, 127 aa, Artificial
  Nanobody sequence
EVQLVESGGGLVQAGGSLRLSCAASGRTFSPYAMGWFRQAPGKEREFVAAISWSGGTTYYADSVKGRFTISRDNAKNTVYLQMNSLKPEDTAVYNCAADVSSTNSGSYIYTWAYDYWGQGTQVTVSS

SEQ ID NO: 406 - protein, 127 aa, Artificial
  Nanobody sequence
EVQLVESGGGLVQAGGSLRLSCTASGRTFSSYAMGWFRQAPGKERDFVAAISWSGGSTYYADSVKGRFTISRDNAKNTVYLKMNSLKPEDTAVYYCAVDASSTNSGSFIYTWAYDYWGQGTQVTVSS

SEQ ID NO: 407 - protein, 128 aa, Artificial
  Nanobody sequence
KVQLVESGGGLVQAGGSLRLSCEASGGSFSSYAMGWFRQAPGKEREFVAAISGWIGPRPVYADSVKGRFTISRDNAENTVYLQMNSLQPEDTAVYTCAADATNRNSGAYFYTWAYDYWGQGTQVTVSS

SEQ ID NO: 408 - protein, 30 aa, Artificial
  Framework sequence
EVQLVESGGGLVQAGDSLRLSCIDSGRTFS

SEQ ID NO: 409 - protein, 30 aa, Artificial
  Framework sequence
EVQLVESGGGLVQAGGSLRLSCAASGGTFS

SEQ ID NO: 410 - protein, 30 aa, Artificial
  Framework sequence
EVQLVESGGDLVQPGGSLRLSCAASGFTFR

SEQ ID NO: 411 - protein, 30 aa, Artificial
  Framework sequence
EVQLVESGGGSVQPGGSLRLSCAASGFTFR

SEQ ID NO: 412 - protein, 30 aa, Artificial
  Framework sequence
EVQLVESGGGLVQPGGSLRLSCAASGFTFR

SEQ ID NO: 413 - protein, 30 aa, Artificial; identical to SEQ ID NO: 412
  Framework sequence

SEQ ID NO: 414 - protein, 30 aa, Artificial
  Framework sequence
EVQLVESGGGLVQPGGSLRLSCAASGFTFS

SEQ ID NO: 415 - protein, 30 aa, Artificial; identical to SEQ ID NO: 411
  Framework sequence

SEQ ID NO: 416 - protein, 30 aa, Artificial
  Framework sequence
KVQLVESGGDLVQPGGSLRLSCAASGFTFR

SEQ ID NO: 417 - protein, 30 aa, Artificial; identical to SEQ ID NO: 411
  Framework sequence

SEQ ID NO: 418 - protein, 30 aa, Artificial; identical to SEQ ID NO: 410
  Framework sequence

SEQ ID NO: 419 - protein, 30 aa, Artificial; identical to SEQ ID NO: 414
  Framework sequence

SEQ ID NO: 420 - protein, 30 aa, Artificial
  Framework sequence
EVQLVESGGGLVQPGGSLRLSCTGSGFTFS

SEQ ID NO: 421 - protein, 30 aa, Artificial; identical to SEQ ID NO: 412
  Framework sequence

SEQ ID NO: 422 - protein, 30 aa, Artificial
  Framework sequence
EVQLVESGGGLVQAGGSLRLSCAASGSTGS

SEQ ID NO: 423 - protein, 30 aa, Artificial; identical to SEQ ID NO: 411
  Framework sequence

SEQ ID NO: 424 - protein, 30 aa, Artificial; identical to SEQ ID NO: 412
  Framework sequence

SEQ ID NO: 425 - protein, 30 aa, Artificial; identical to SEQ ID NO: 412
  Framework sequence

SEQ ID NO: 426 - protein, 30 aa, Artificial
  Framework sequence
EVQLVESGGGLVQPGGSLRLSCAASGFTFG

SEQ ID NO: 427 - protein, 30 aa, Artificial; identical to SEQ ID NO: 410
  Framework sequence

SEQ ID NO: 428 - protein, 30 aa, Artificial
  Framework sequence
EVQLVESGGGLVQAGGSLRLSCAASGRTFS

SEQ ID NO: 429 - protein, 30 aa, Artificial; identical to SEQ ID NO: 412
  Framework sequence

SEQ ID NO: 430 - protein, 30 aa, Artificial; identical to SEQ ID NO: 411
  Framework sequence

SEQ ID NO: 431 - protein, 30 aa, Artificial; identical to SEQ ID NO: 414
  Framework sequence

SEQ ID NO: 432 - protein, 30 aa, Artificial; identical to SEQ ID NO: 410
  Framework sequence

SEQ ID NO: 433 - protein, 30 aa, Artificial; identical to SEQ ID NO: 410
  Framework sequence

SEQ ID NO: 434 - protein, 30 aa, Artificial
  Framework sequence
EVQLVESGGGLVQPGGSLRLSCAASGLIFS

SEQ ID NO: 435 - protein, 30 aa, Artificial; identical to SEQ ID NO: 412
  Framework sequence

SEQ ID NO: 436 - protein, 30 aa, Artificial
  Framework sequence
EVQLMESGGGLVQAGGSLRLSCAASGRTFS

SEQ ID NO: 437 - protein, 30 aa, Artificial; identical to SEQ ID NO: 411
  Framework sequence

SEQ ID NO: 438 - protein, 30 aa, Artificial
  Framework sequence
EVQLVESGGDLVQPGGSLRLSCAASGFTFS

SEQ ID NO: 439 - protein, 30 aa, Artificial; identical to SEQ ID NO: 411
  Framework sequence

SEQ ID NO: 440 - protein, 30 aa, Artificial; identical to SEQ ID NO: 428
  Framework sequence

SEQ ID NO: 441 - protein, 30 aa, Artificial
  Framework sequence
EVQLVESGGGLVQAGGSLRLSCEASGRTYS

SEQ ID NO: 442 - protein, 30 aa, Artificial
  Framework sequence
EVQLVESGGGLVQAGGSLRLSCAASERTVI

SEQ ID NO: 443 - protein, 30 aa, Artificial
  Framework sequence
EVQLVESGGGLVQPGGSLRLSCAASGLTFR

SEQ ID NO: 444 - protein, 30 aa, Artificial
  Framework sequence
EVQLVESGGGLVQAGGSLRLSCAASEGYFR

SEQ ID NO: 445 - protein, 30 aa, Artificial
  Framework sequence
EVQLVESGGGLVQAGGSLRLSCEASGRTFS

SEQ ID NO: 446 - protein, 30 aa, Artificial
  Framework sequence
EVQLVESGGGLVQAGGSLRLSCEASGRTER

SEQ ID NO: 447 - protein, 30 aa, Artificial
  Framework sequence
EVQLVESGGGLVQAGGSLRLSCATSGRTRS

SEQ ID NO: 448 - protein, 30 aa, Artificial
  Framework sequence
EVQLVESGGGLVQAGGSLRLSCAASGPTFS

SEQ ID NO: 449 - protein, 30 aa, Artificial; identical to SEQ ID NO: 445
  Framework sequence

SEQ ID NO: 450 - protein, 30 aa, Artificial
  Framework sequence
EVQLVESGGGLVQAGGSLRLSCAASGIIFS

SEQ ID NO: 451 - protein, 30 aa, Artificial; identical to SEQ ID NO: 445
  Framework sequence

SEQ ID NO: 452 - protein, 30 aa, Artificial
  Framework sequence
EVQLVESGGGLVQAGGSLRLSCTASGRTFS

SEQ ID NO: 453 - protein, 30 aa, Artificial
  Framework sequence
EVQLVESGGGLVQTGGSLRLSCAASGRTFS

SEQ ID NO: 454 - protein, 30 aa, Artificial; identical to SEQ ID NO: 453
  Framework sequence

SEQ ID NO: 455 - protein, 30 aa, Artificial
  Framework sequence
EVQLVESGGGLVQAGGSLRLSCAASVRTFS

SEQ ID NO: 456 - protein, 30 aa, Artificial; identical to SEQ ID NO: 442
  Framework sequence

SEQ ID NO: 457 - protein, 30 aa, Artificial; identical to SEQ ID NO: 442
  Framework sequence

SEQ ID NO: 458 - protein, 30 aa, Artificial; identical to SEQ ID NO: 444
  Framework sequence

SEQ ID NO: 459 - protein, 30 aa, Artificial; identical to SEQ ID NO: 444
  Framework sequence

SEQ ID NO: 460 - protein, 30 aa, Artificial; identical to SEQ ID NO: 445
  Framework sequence

SEQ ID NO: 461 - protein, 30 aa, Artificial
  Framework sequence
EVQLVESGGELVQAGDSLTVSCAASGRTFS

SEQ ID NO: 462 - protein, 30 aa, Artificial; identical to SEQ ID NO: 414
  Framework sequence

SEQ ID NO: 463 - protein, 30 aa, Artificial; identical to SEQ ID NO: 441
  Framework sequence

SEQ ID NO: 464 - protein, 30 aa, Artificial
  Framework sequence
EVQLVESGGGLVQPGGSLRLSCAASGSSFS

SEQ ID NO: 465 - protein, 30 aa, Artificial; identical to SEQ ID NO: 464
  Framework sequence

SEQ ID NO: 466 - protein, 30 aa, Artificial
  Framework sequence
EMQLVESGGGLVQAGGSLRLSCEASGRSFS

SEQ ID NO: 467 - protein, 30 aa, Artificial
  Framework sequence
EVQLVESGGGLVQAGGSLRLSCAASGFTFD

SEQ ID NO: 468 - protein, 30 aa, Artificial
  Framework sequence
EVQLVESGGGLVQAGGSLRLSCEASGGSFS

SEQ ID NO: 469 - protein, 30 aa, Artificial
  Framework sequence
EVQLVESGGGLVQAGGSLRLSCEASGRSFS

SEQ ID NO: 470 - protein, 30 aa, Artificial; identical to SEQ ID NO: 445
  Framework sequence

SEQ ID NO: 471 - protein, 30 aa, Artificial; identical to SEQ ID NO: 445
  Framework sequence

SEQ ID NO: 472 - protein, 30 aa, Artificial; identical to SEQ ID NO: 445
  Framework sequence

SEQ ID NO: 473 - protein, 30 aa, Artificial; identical to SEQ ID NO: 445
  Framework sequence

SEQ ID NO: 474 - protein, 30 aa, Artificial
  Framework sequence
EVQLVESGGGLVQAGGSLRLSCEASRRTFS

SEQ ID NO: 475 - protein, 30 aa, Artificial; identical to SEQ ID NO: 446
  Framework sequence

SEQ ID NO: 476 - protein, 30 aa, Artificial; identical to SEQ ID NO: 445
  Framework sequence

SEQ ID NO: 477 - protein, 30 aa, Artificial
  Framework sequence
EVQLVESGGGLVQPGGSLGLSCAASGNIFS

SEQ ID NO: 478 - protein, 30 aa, Artificial
  Framework sequence
EVQLVESGGGSVQPGGSARLSCAVLGSIGS

SEQ ID NO: 479 - protein, 30 aa, Artificial
  Framework sequence
EVQLVESGGGLAQPGGSLRLSCAASGFTFN

SEQ ID NO: 480 - protein, 30 aa, Artificial; identical to SEQ ID NO: 442
  Framework sequence

SEQ ID NO: 481 - protein, 30 aa, Artificial
  Framework sequence
EVQLVESGGGLVQAGGSLRLSCAASERTFI

SEQ ID NO: 482 - protein, 30 aa, Artificial
  Framework sequence
EVQLVESGGGLVQPGGSLRLSCAASGFVFS

SEQ ID NO: 483 - protein, 30 aa, Artificial
  Framework sequence
EVQLVESGGGLVQPGGSLTLSCAASGSVFS

SEQ ID NO: 484 - protein, 30 aa, Artificial
  Framework sequence
EVQLVESGGGLVQPGGSLRLSCAASGFTFD

SEQ ID NO: 485 - protein, 30 aa, Artificial
  Framework sequence
EVQLVESGGGLVQAGGSLRLSCTASGRTLS

SEQ ID NO: 486 - protein, 30 aa, Artificial
  Framework sequence
EVQLVESGGGLVQAGGSLRLSCTAGGDTFS

SEQ ID NO: 487 - protein, 30 aa, Artificial; identical to SEQ ID NO: 482
  Framework sequence

SEQ ID NO: 488 - protein, 30 aa, Artificial
  Framework sequence
EVQLVESGGGLVQAGGSLRLSCAAPGRTFS

SEQ ID NO: 489 - protein, 30 aa, Artificial; identical to SEQ ID NO: 482
  Framework sequence

SEQ ID NO: 490 - protein, 30 aa, Artificial
  Framework sequence
EVQMVESGGGLVQPGGSLRLSCVASGSIAR

SEQ ID NO: 491 - protein, 30 aa, Artificial
  Framework sequence
EVQLVESGGGLVQAGGSLRLSCAASGSLFR

SEQ ID NO: 492 - protein, 30 aa, Artificial; identical to SEQ ID NO: 448
  Framework sequence

SEQ ID NO: 493 - protein, 30 aa, Artificial; identical to SEQ ID NO: 445
  Framework sequence

SEQ ID NO: 494 - protein, 30 aa, Artificial; identical to SEQ ID NO: 448
  Framework sequence

SEQ ID NO: 495 - protein, 30 aa, Artificial; identical to SEQ ID NO: 448
  Framework sequence

SEQ ID NO: 496 - protein, 30 aa, Artificial
  Framework sequence
EVQLVESGGGLVQPGGSLRLSCAASGSIFS

SEQ ID NO: 497 - protein, 30 aa, Artificial; identical to SEQ ID NO: 496
  Framework sequence

SEQ ID NO: 498 - protein, 30 aa, Artificial
  Framework sequence
EVQLVESGGGLVQAGGSLRLSCVASGRTFN

SEQ ID NO: 499 - protein, 30 aa, Artificial
  Framework sequence
EVQLVESGGGLVQAGGSLRLSCAASGSSGV

SEQ ID NO: 500 - protein, 30 aa, Artificial; identical to SEQ ID NO: 491
  Framework sequence

SEQ ID NO: 501 - protein, 30 aa, Artificial; identical to SEQ ID NO: 496
  Framework sequence

SEQ ID NO: 502 - protein, 30 aa, Artificial; identical to SEQ ID NO: 448
  Framework sequence

SEQ ID NO: 503 - protein, 30 aa, Artificial; identical to SEQ ID NO: 445
  Framework sequence

SEQ ID NO: 504 - protein, 30 aa, Artificial
  Framework sequence
EVQLVESGGGSVQPGGSLRLSCAASGSIVG

SEQ ID NO: 505 - protein, 30 aa, Artificial; identical to SEQ ID NO: 496
  Framework sequence

SEQ ID NO: 506 - protein, 30 aa, Artificial; identical to SEQ ID NO: 441
  Framework sequence

SEQ ID NO: 507 - protein, 30 aa, Artificial
  Framework sequence
EVQLVESGGGLVQPGGSLKLSCAASGGFFS

SEQ ID NO: 508 - protein, 30 aa, Artificial
  Framework sequence
EVQLVESGGGLVQPGGSLRLSCAASGSIFG

SEQ ID NO: 509 - protein, 30 aa, Artificial
  Framework sequence
EVQLVESGGGLVQPGGSLRLSCAASGSIVG

SEQ ID NO: 510 - protein, 30 aa, Artificial
  Framework sequence
EVQLVESGGGLVQAGGSLKLSCAVSARIFS

SEQ ID NO: 511 - protein, 30 aa, Artificial; identical to SEQ ID NO: 428
  Framework sequence

SEQ ID NO: 512 - protein, 30 aa, Artificial; identical to SEQ ID NO: 428
  Framework sequence

SEQ ID NO: 513 - protein, 30 aa, Artificial
  Framework sequence
EVQLVESGGGLVQAGGSLRLSCAASGRTGG

SEQ ID NO: 514 - protein, 30 aa, Artificial
  Framework sequence
EVQLVESGAGLVQAGGSLRLSCTASGRTFS

SEQ ID NO: 515 - protein, 30 aa, Artificial
  Framework sequence
EVQLVKSGGGLVQAGGSLKLSCAASGRAFS

SEQ ID NO: 516 - protein, 30 aa, Artificial; identical to SEQ ID NO: 482
  Framework sequence

SEQ ID NO: 517 - protein, 30 aa, Artificial; identical to SEQ ID NO: 442
  Framework sequence

SEQ ID NO: 518 - protein, 30 aa, Artificial; identical to SEQ ID NO: 428
  Framework sequence

SEQ ID NO: 519 - protein, 30 aa, Artificial
  Framework sequence
EVQLVESGGGLVQAGGSLRLSCTVSGDTFD

SEQ ID NO: 520 - protein, 30 aa, Artificial; identical to SEQ ID NO: 426
  Framework sequence

SEQ ID NO: 521 - protein, 30 aa, Artificial; identical to SEQ ID NO: 519
  Framework sequence

SEQ ID NO: 522 - protein, 30 aa, Artificial
  Framework sequence
EVQLVESGGGLVQAGASLRLSCAASGSTLS

SEQ ID NO: 523 - protein, 30 aa, Artificial
  Framework sequence
EVQLVESGGGLVQAGGSLRLSCAASGRTLS

SEQ ID NO: 524 - protein, 30 aa, Artificial
  Framework sequence
EVQLVKSGGGSVQAGGSLRLSCAASGGTFN

SEQ ID NO: 525 - protein, 30 aa, Artificial
  Framework sequence
EVQLVESGGGLVQPGGSLRLSCAASGFIFG

SEQ ID NO: 526 - protein, 30 aa, Artificial
  Framework sequence
EVQLVESGGGLVQAGGSLRLSCAASGGRTF

SEQ ID NO: 527 - protein, 30 aa, Artificial
  Framework sequence
EVQLVESGGGSVQAGGSLRLSCAASGGTFN

SEQ ID NO: 528 - protein, 30 aa, Artificial
  Framework sequence
EVQLVESGGDLVQAGGSLRLSCVASGSTYS

SEQ ID NO: 529 - protein, 30 aa, Artificial; identical to SEQ ID NO: 527
  Framework sequence

SEQ ID NO: 530 - protein, 30 aa, Artificial
  Framework sequence
EVQLVESGGGLAQAGGSLRLSCAASGRTLT

SEQ ID NO: 531 - protein, 30 aa, Artificial
  Framework sequence
EVQLVESGGGLVQPGGSLRVSCAASGFTFN

SEQ ID NO: 532 - protein, 30 aa, Artificial; identical to SEQ ID NO: 531
  Framework sequence

SEQ ID NO: 533 - protein, 30 aa, Artificial
  Framework sequence
EVQLVESGGGLVQPGGSLRLSCAASGFTFN

SEQ ID NO: 534 - protein, 30 aa, Artificial
  Framework sequence
EVQLVESGGGLVQAGGSLRLSCVASGGTFS

SEQ ID NO: 535 - protein, 30 aa, Artificial
  Framework sequence
EVQLVESGGGLVQPGGSLRLSCTAYGFIFD

SEQ ID NO: 536 - protein, 30 aa, Artificial; identical to SEQ ID NO: 535
  Framework sequence

SEQ ID NO: 537 - protein, 30 aa, Artificial; identical to SEQ ID NO: 535
  Framework sequence

SEQ ID NO: 538 - protein, 30 aa, Artificial
  Framework sequence
EVQLVESGGDLVQPGGSLRLSCTAYGFIFD

SEQ ID NO: 539 - protein, 30 aa, Artificial; identical to SEQ ID NO: 535
  Framework sequence

SEQ ID NO: 540 - protein, 30 aa, Artificial; identical to SEQ ID NO: 535
  Framework sequence

SEQ ID NO: 541 - protein, 30 aa, Artificial
  Framework sequence
EVQMVESGGDLVQPGGSLRLSCTAYGFIFD

SEQ ID NO: 542 - protein, 30 aa, Artificial; identical to SEQ ID NO: 538
  Framework sequence

SEQ ID NO: 543 - protein, 30 aa, Artificial
  Framework sequence
EVQLVESGGGLVQPGGSLRLSCTAYGFVFD

SEQ ID NO: 544 - protein, 30 aa, Artificial
  Framework sequence
EVQLVESGGGLVQPGGSLRLSCEASGFTWD

SEQ ID NO: 545 - protein, 30 aa, Artificial
  Framework sequence
EVQLVESGGGLVQPGGSLRLSCAASGLTLD

SEQ ID NO: 546 - protein, 30 aa, Artificial
  Framework sequence
EVQPVESGGGLVQPGGSLRLSCEASGFTWD

SEQ ID NO: 547 - protein, 30 aa, Artificial; identical to SEQ ID NO: 544
  Framework sequence

SEQ ID NO: 548 - protein, 30 aa, Artificial; identical to SEQ ID NO: 545
  Framework sequence

SEQ ID NO: 549 - protein, 30 aa, Artificial; identical to SEQ ID NO: 545
  Framework sequence

SEQ ID NO: 550 - protein, 30 aa, Artificial; identical to SEQ ID NO: 544
  Framework sequence

SEQ ID NO: 551 - protein, 30 aa, Artificial; identical to SEQ ID NO: 545
  Framework sequence

SEQ ID NO: 552 - protein, 30 aa, Artificial
  Framework sequence
EVQLVESGGGLVQPGGSLRLSCAASGFTSD

SEQ ID NO: 553 - protein, 30 aa, Artificial
  Framework sequence
EVQLVESGGGLVQPGGSLRLSCAASGFTWD

SEQ ID NO: 554 - protein, 30 aa, Artificial; identical to SEQ ID NO: 553
  Framework sequence

SEQ ID NO: 555 - protein, 30 aa, Artificial
  Framework sequence
EVQLEESGGGLVQPGGSLRLSCEASGFTWD

SEQ ID NO: 556 - protein, 30 aa, Artificial; identical to SEQ ID NO: 545
  Framework sequence

SEQ ID NO: 557 - protein, 30 aa, Artificial; identical to SEQ ID NO: 545
  Framework sequence

SEQ ID NO: 558 - protein, 30 aa, Artificial; identical to SEQ ID NO: 553
  Framework sequence

SEQ ID NO: 559 - protein, 30 aa, Artificial
  Framework sequence
EVQLVESGGGLVQPGGSVRLSCAASGFTWD

SEQ ID NO: 560 - protein, 30 aa, Artificial; identical to SEQ ID NO: 544
  Framework sequence

SEQ ID NO: 561 - protein, 30 aa, Artificial; identical to SEQ ID NO: 545
  Framework sequence

SEQ ID NO: 562 - protein, 30 aa, Artificial; identical to SEQ ID NO: 545
  Framework sequence

SEQ ID NO: 563 - protein, 30 aa, Artificial; identical to SEQ ID NO: 545
  Framework sequence

SEQ ID NO: 564 - protein, 30 aa, Artificial; identical to SEQ ID NO: 545
  Framework sequence

SEQ ID NO: 565 - protein, 30 aa, Artificial; identical to SEQ ID NO: 553
  Framework sequence

SEQ ID NO: 566 - protein, 30 aa, Artificial; identical to SEQ ID NO: 545
  Framework sequence

SEQ ID NO: 567 - protein, 30 aa, Artificial; identical to SEQ ID NO: 544
  Framework sequence

SEQ ID NO: 568 - protein, 30 aa, Artificial; identical to SEQ ID NO: 545
  Framework sequence

SEQ ID NO: 569 - protein, 30 aa, Artificial; identical to SEQ ID NO: 553
  Framework sequence

SEQ ID NO: 570 - protein, 30 aa, Artificial; identical to SEQ ID NO: 553
  Framework sequence

SEQ ID NO: 571 - protein, 30 aa, Artificial; identical to SEQ ID NO: 545
  Framework sequence

SEQ ID NO: 572 - protein, 30 aa, Artificial; identical to SEQ ID NO: 545
  Framework sequence

SEQ ID NO: 573 - protein, 30 aa, Artificial; identical to SEQ ID NO: 545
  Framework sequence

SEQ ID NO: 574 - protein, 30 aa, Artificial; identical to SEQ ID NO: 545
  Framework sequence

SEQ ID NO: 575 - protein, 30 aa, Artificial; identical to SEQ ID NO: 544
  Framework sequence

SEQ ID NO: 576 - protein, 30 aa, Artificial; identical to SEQ ID NO: 545
  Framework sequence

SEQ ID NO: 577 - protein, 30 aa, Artificial; identical to SEQ ID NO: 545
  Framework sequence

SEQ ID NO: 578 - protein, 30 aa, Artificial
  Framework sequence
EVQLVESGGGLVQPGGSLRLSCVASGLTLD

SEQ ID NO: 579 - protein, 30 aa, Artificial; identical to SEQ ID NO: 553
  Framework sequence

SEQ ID NO: 580 - protein, 30 aa, Artificial; identical to SEQ ID NO: 545
  Framework sequence

SEQ ID NO: 581 - protein, 30 aa, Artificial; identical to SEQ ID NO: 545
  Framework sequence

SEQ ID NO: 582 - protein, 30 aa, Artificial; identical to SEQ ID NO: 545
  Framework sequence

SEQ ID NO: 583 - protein, 30 aa, Artificial; identical to SEQ ID NO: 545
  Framework sequence

SEQ ID NO: 584 - protein, 30 aa, Artificial; identical to SEQ ID NO: 545
  Framework sequence

SEQ ID NO: 585 - protein, 30 aa, Artificial
  Framework sequence
EVQLMESGGGLVQPGGSLRLSCATSGFTLD

SEQ ID NO: 586 - protein, 30 aa, Artificial
  Framework sequence
EVQLVESGGGLVQPGGSLRLSCATSGFTLD

SEQ ID NO: 587 - protein, 30 aa, Artificial
  Framework sequence
EVQLVESRGGLVQPGGSLRLSCATSGFTLD

SEQ ID NO: 588 - protein, 30 aa, Artificial
  Framework sequence
EVQLVESGGGLVRPGGSLRLSCATSGFTED

SEQ ID NO: 589 - protein, 30 aa, Artificial
  Framework sequence
EVQLVESGGGLVQPGGSLTLSCATSGLTLD

SEQ ID NO: 590 - protein, 30 aa, Artificial
  Framework sequence
EVQLVESGGGLVQPGGSLRLSCATSGFTED

SEQ ID NO: 591 - protein, 30 aa, Artificial; identical to SEQ ID NO: 586
  Framework sequence

SEQ ID NO: 592 - protein, 30 aa, Artificial
  Framework sequence
EVQLVESGGGLVQPGGSLRLSCATSGLTLD

SEQ ID NO: 593 - protein, 30 aa, Artificial
  Framework sequence
EVQLVESGGGLVQPGGSLRLSCATSGFTMD

SEQ ID NO: 594 - protein, 30 aa, Artificial; identical to SEQ ID NO: 589
  Framework sequence

SEQ ID NO: 595 - protein, 30 aa, Artificial; identical to SEQ ID NO: 590
  Framework sequence

SEQ ID NO: 596 - protein, 30 aa, Artificial; identical to SEQ ID NO: 586
  Framework sequence

SEQ ID NO: 597 - protein, 30 aa, Artificial; identical to SEQ ID NO: 586
  Framework sequence

SEQ ID NO: 598 - protein, 30 aa, Artificial; identical to SEQ ID NO: 467
  Framework sequence

SEQ ID NO: 599 - protein, 30 aa, Artificial; identical to SEQ ID NO: 467
  Framework sequence

SEQ ID NO: 600 - protein, 30 aa, Artificial; identical to SEQ ID NO: 467
  Framework sequence

SEQ ID NO: 601 - protein, 30 aa, Artificial; identical to SEQ ID NO: 467
  Framework sequence

SEQ ID NO: 602 - protein, 30 aa, Artificial; identical to SEQ ID NO: 467
  Framework sequence

SEQ ID NO: 603 - protein, 30 aa, Artificial; identical to SEQ ID NO: 467
  Framework sequence

SEQ ID NO: 604 - protein, 30 aa, Artificial
  Framework sequence
EVQLVESGGGLVQAGGSLRLSCAASGLTFD

SEQ ID NO: 605 - protein, 30 aa, Artificial; identical to SEQ ID NO: 467
  Framework sequence

SEQ ID NO: 606 - protein, 30 aa, Artificial; identical to SEQ ID NO: 467
  Framework sequence

SEQ ID NO: 607 - protein, 30 aa, Artificial; identical to SEQ ID NO: 467
  Framework sequence

SEQ ID NO: 608 - protein, 30 aa, Artificial; identical to SEQ ID NO: 467
  Framework sequence

SEQ ID NO: 609 - protein, 30 aa, Artificial
  Framework sequence
EVQLVESGGGKVQPGGSLRLSCAASGFTFD

SEQ ID NO: 610 - protein, 30 aa, Artificial; identical to SEQ ID NO: 428
  Framework sequence

SEQ ID NO: 611 - protein, 30 aa, Artificial
  Framework sequence
EVQLVQSGGGLVQAGGSLRLSCAASGRTFS

SEQ ID NO: 612 - protein, 30 aa, Artificial; identical to SEQ ID NO: 428
  Framework sequence

SEQ ID NO: 613 - protein, 30 aa, Artificial; identical to SEQ ID NO: 428
  Framework sequence

SEQ ID NO: 614 - protein, 30 aa, Artificial; identical to SEQ ID NO: 428
  Framework sequence

SEQ ID NO: 615 - protein, 30 aa, Artificial
  Framework sequence
EVQLVESGGGLVQAGGSLRLSCADHGRTLA

SEQ ID NO: 616 - protein, 30 aa, Artificial
  Framework sequence
EVQLVESGGGLVQAGDSLRLSCTASERTFR

SEQ ID NO: 617 - protein, 30 aa, Artificial
  Framework sequence
EVQLVESGGGLVQAGDSLRLSCTASERTFG

SEQ ID NO: 618 - protein, 30 aa, Artificial; identical to SEQ ID NO: 617
  Framework sequence

SEQ ID NO: 619 - protein, 30 aa, Artificial
  Framework sequence
EVQLVESGGGLVHPGGSLRLSCAASERTFG

SEQ ID NO: 620 - protein, 30 aa, Artificial
  Framework sequence
EVQLVESGGGLVQPGGSLRLSCAASGSIWS

SEQ ID NO: 621 - protein, 30 aa, Artificial
  Framework sequence
EVQLVESGGGLVQPGGSLSVSCAASGTIFA

SEQ ID NO: 622 - protein, 30 aa, Artificial
  Framework sequence
EVQLVESGGGLVQAGASLRLSCAASGLAFS

SEQ ID NO: 623 - protein, 30 aa, Artificial
  Framework sequence
EVQLVESGGGLVHAGASLRLSCVASGLAFS

SEQ ID NO: 624 - protein, 30 aa, Artificial; identical to SEQ ID NO: 622
  Framework sequence

SEQ ID NO: 625 - protein, 30 aa, Artificial; identical to SEQ ID NO: 622
  Framework sequence

SEQ ID NO: 626 - protein, 30 aa, Artificial; identical to SEQ ID NO: 623
  Framework sequence

SEQ ID NO: 627 - protein, 30 aa, Artificial; identical to SEQ ID NO: 622
  Framework sequence

SEQ ID NO: 628 - protein, 30 aa, Artificial
  Framework sequence
EVQLVESGGGLVQAGGSLRLSCAASVGTFS

SEQ ID NO: 629 - protein, 30 aa, Artificial
  Framework sequence
EVQLVESGGGLVQPGGSLRLSCAASAGTFS

SEQ ID NO: 630 - protein, 30 aa, Artificial
  Framework sequence
EVQLVESGGGLVQPGGSLRLSCAASAGTLS

SEQ ID NO: 631 - protein, 30 aa, Artificial
  Framework sequence
EVQLVESGGGLVQPGGSLRLSCAASGFTLD

SEQ ID NO: 632 - protein, 30 aa, Artificial
  Framework sequence
EVQLVESGGGLVQPGESLRLSCAASGFTLA

SEQ ID NO: 633 - protein, 30 aa, Artificial; identical to SEQ ID NO: 428
  Framework sequence

SEQ ID NO: 634 - protein, 30 aa, Artificial
  Framework sequence
EVQLVESGGGLVQAGDSLRLSCAASGRSFS

SEQ ID NO: 635 - protein, 30 aa, Artificial
  Framework sequence
EVQLVESGGGLVQAGGSLRLSCGSSGRTFS

SEQ ID NO: 636 - protein, 30 aa, Artificial
  Framework sequence
EVQLVESGGGLVQAGDSLRLSCAASGRTFS

SEQ ID NO: 637 - protein, 30 aa, Artificial; identical to SEQ ID NO: 635
  Framework sequence

SEQ ID NO: 638 - protein, 30 aa, Artificial
  Framework sequence
EVQLVESRGGLVQAGGSLRLSCGSSGRTFS

SEQ ID NO: 639 - protein, 30 aa, Artificial; identical to SEQ ID NO: 635
  Framework sequence

SEQ ID NO: 640 - protein, 30 aa, Artificial
  Framework sequence
EVQLVESGGGWVQAGGSLRLSCAASGRAFS

SEQ ID NO: 641 - protein, 30 aa, Artificial; identical to SEQ ID NO: 640
  Framework sequence

SEQ ID NO: 642 - protein, 30 aa, Artificial; identical to SEQ ID NO: 428
  Framework sequence

SEQ ID NO: 643 - protein, 30 aa, Artificial
  Framework sequence
EVQLVESGGGLVQAGGSLRLSCVASGLTFE

SEQ ID NO: 644 - protein, 30 aa, Artificial
  Framework sequence
EVQLVESGGGLVQPGGSLRLSCSASGFTFS

SEQ ID NO: 645 - protein, 30 aa, Artificial
  Framework sequence
EVQLVESGGGLVQAGGSLRLSCVASGRSFS

SEQ ID NO: 646 - protein, 30 aa, Artificial
  Framework sequence
EVQLVESGGGLVQAGGSLRLSCAASGLTLD

SEQ ID NO: 647 - protein, 30 aa, Artificial
  Framework sequence
EVQLMESGGGLVQAGGSLRLSCAASGGTFS

SEQ ID NO: 648 - protein, 30 aa, Artificial; identical to SEQ ID NO: 467
  Framework sequence

SEQ ID NO: 649 - protein, 30 aa, Artificial; identical to SEQ ID NO: 426
  Framework sequence

SEQ ID NO: 650 - protein, 30 aa, Artificial
  Framework sequence
EVQLVESGGGLVQAGGSLRLSCAASGFAVD

SEQ ID NO: 651 - protein, 30 aa, Artificial
  Framework sequence
EVQLVESGGGLVQPGGSLRLSCAASGSDFG

SEQ ID NO: 652 - protein, 30 aa, Artificial
  Framework sequence
EVQLVESGGGLVQAGGSLRLSCAASGRTVS

SEQ ID NO: 653 - protein, 30 aa, Artificial
  Framework sequence
EVQLVESGGGLVQAGGSLRLSCAASGRSFS

SEQ ID NO: 654 - protein, 30 aa, Artificial
  Framework sequence
EVQLVESGGGLVQAGGSLSISCAASGGSLS

SEQ ID NO: 655 - protein, 30 aa, Artificial
  Framework sequence
EVQLAESGGGLVQPGGSLRLSCAASGFTFE

SEQ ID NO: 656 - protein, 30 aa, Artificial
  Framework sequence
EVQLVESGGGLVQAGGSLRLSCTASARRFS

SEQ ID NO: 657 - protein, 30 aa, Artificial
  Framework sequence
EVQLVESGGGLVQAGASLRLSCAASGRMFS

SEQ ID NO: 658 - protein, 30 aa, Artificial
  Framework sequence
EVQLVESGGGLVQPGGSLRLSCVASGLTFS

SEQ ID NO: 659 - protein, 30 aa, Artificial
  Framework sequence
EVQLVESGGGLVQAGGSLRLSCAASGLTFS

SEQ ID NO: 660 - protein, 30 aa, Artificial; identical to SEQ ID NO: 659
  Framework sequence

SEQ ID NO: 661 - protein, 30 aa, Artificial
  Framework sequence
EVQLVESGGGLVQPGGSLRLSCAASGLTFS

SEQ ID NO: 662 - protein, 30 aa, Artificial
  Framework sequence
EVQLVESGGGLVQPGGSLRLSCAASGRTFS

SEQ ID NO: 663 - protein, 30 aa, Artificial
  Framework sequence
EVQLVESGGGLVQAGGSLKLSCAASGRAFS

SEQ ID NO: 664 - protein, 30 aa, Artificial; identical to SEQ ID NO: 428
  Framework sequence

SEQ ID NO: 665 - protein, 30 aa, Artificial; identical to SEQ ID NO: 412
  Framework sequence

SEQ ID NO: 666 - protein, 30 aa, Artificial; identical to SEQ ID NO: 467
  Framework sequence

SEQ ID NO: 667 - protein, 30 aa, Artificial; identical to SEQ ID NO: 448
  Framework sequence

SEQ ID NO: 668 - protein, 30 aa, Artificial; identical to SEQ ID NO: 498
  Framework sequence

SEQ ID NO: 669 - protein, 30 aa, Artificial
  Framework sequence
EVQLVESGGGLVQPGGSLRLSCEASGFTFS

SEQ ID NO: 670 - protein, 30 aa, Artificial
  Framework sequence
EVQLVESGGGLVQAGDSLRLSCAASGLTFS

SEQ ID NO: 671 - protein, 30 aa, Artificial
  Framework sequence
EVQLVESGGGLVQAGGSLRLSCAASERTFS

SEQ ID NO: 672 - protein, 30 aa, Artificial; identical to SEQ ID NO: 631
  Framework sequence

SEQ ID NO: 673 - protein, 30 aa, Artificial
  Framework sequence
EVQLVESGGGLVQPGGSLKLSCAGSGSIFR

SEQ ID NO: 674 - protein, 30 aa, Artificial
  Framework sequence
EVQLVESGGGLVQAGGSPRLSCAASGGTFS

SEQ ID NO: 675 - protein, 30 aa, Artificial
  Framework sequence
EVQLVESGGGLVQAGGSLRLSCASSGSIYS

SEQ ID NO: 676 - protein, 30 aa, Artificial
  Framework sequence
EVQLVESGGGLVQPGGSLRLSCAASGNIFS

SEQ ID NO: 677 - protein, 30 aa, Artificial; identical to SEQ ID NO: 670
  Framework sequence

SEQ ID NO: 678 - protein, 30 aa, Artificial
  Framework sequence
EVQLVESGGGLVQVGDSLRLSCAASGLTFS

SEQ ID NO: 679 - protein, 30 aa, Artificial; identical to SEQ ID NO: 670
  Framework sequence

SEQ ID NO: 680 - protein, 30 aa, Artificial; identical to SEQ ID NO: 670
  Framework sequence

SEQ ID NO: 681 - protein, 30 aa, Artificial; identical to SEQ ID NO: 670
  Framework sequence

SEQ ID NO: 682 - protein, 30 aa, Artificial
  Framework sequence
EVQLVESGGGLVQPGGSLRLSCAASGFAFS

SEQ ID NO: 683 - protein, 30 aa, Artificial; identical to SEQ ID NO: 445
  Framework sequence

SEQ ID NO: 684 - protein, 30 aa, Artificial; identical to SEQ ID NO: 445
  Framework sequence

SEQ ID NO: 685 - protein, 30 aa, Artificial; identical to SEQ ID NO: 445
  Framework sequence

SEQ ID NO: 686 - protein, 30 aa, Artificial; identical to SEQ ID NO: 428
  Framework sequence

SEQ ID NO: 687 - protein, 30 aa, Artificial; identical to SEQ ID NO: 428
  Framework sequence

SEQ ID NO: 688 - protein, 30 aa, Artificial; identical to SEQ ID NO: 452
  Framework sequence

SEQ ID NO: 689 - protein, 30 aa, Artificial
  Framework sequence
KVQLVESGGGLVQAGGSLRLSCEASGGSFS

SEQ ID NO: 690 - protein, 5 aa, Artificial
  CDR1 sequence
DYPIG

SEQ ID NO: 691 - protein, 5 aa, Artificial
  CDR1 sequence
SYAMG

SEQ ID NO: 692 - protein, 5 aa, Artificial
  CDR1 sequence
GYWMT

SEQ ID NO: 693 - protein, 5 aa, Artificial
  CDR1 sequence
GYWMS

SEQ ID NO: 694 - protein, 5 aa, Artificial
  CDR1 sequence
GYWMS

SEQ ID NO: 695 - protein, 5 aa, Artificial
  CDR1 sequence
GYWMS

SEQ ID NO: 696 - protein, 5 aa, Artificial
  CDR1 sequence
GYWMS

SEQ ID NO: 697 - protein, 5 aa, Artificial
  CDR1 sequence
GYWMS

SEQ ID NO: 698 - protein, 5 aa, Artificial
  CDR1 sequence
GYWMT

SEQ ID NO: 699 - protein, 5 aa, Artificial
  CDR1 sequence
GYWMS

SEQ ID NO: 700 - protein, 5 aa, Artificial
  CDR1 sequence
GYWMT

SEQ ID NO: 701 - protein, 5 aa, Artificial
  CDR1 sequence
GYWMS

SEQ ID NO: 702 - protein, 5 aa, Artificial
  CDR1 sequence
SYWMD

SEQ ID NO: 703 - protein, 5 aa, Artificial
  CDR1 sequence
GYWMS

SEQ ID NO: 704 - protein, 5 aa, Artificial
  CDR1 sequence
STAMG

SEQ ID NO: 705 - protein, 5 aa, Artificial
  CDR1 sequence
GYWMS

SEQ ID NO: 706 - protein, 5 aa, Artificial
  CDR1 sequence
GYWMS

SEQ ID NO: 707 - protein, 5 aa, Artificial
  CDR1 sequence
GYWMS

SEQ ID NO: 708 - protein, 5 aa, Artificial
  CDR1 sequence
GYWMT

SEQ ID NO: 709 - protein, 5 aa, Artificial
  CDR1 sequence
GYWMT

SEQ ID NO: 710 - protein, 5 aa, Artificial
  CDR1 sequence
SYAMG

SEQ ID NO: 711 - protein, 5 aa, Artificial
  CDR1 sequence
GYWMS

SEQ ID NO: 712 - protein, 5 aa, Artificial
  CDR1 sequence
GYWMS

SEQ ID NO: 713 - protein, 5 aa, Artificial
  CDR1 sequence
GYWMS

SEQ ID NO: 714 - protein, 5 aa, Artificial
  CDR1 sequence
GYWMT

SEQ ID NO: 715 - protein, 5 aa, Artificial
  CDR1 sequence
GYWMT

SEQ ID NO: 716 - protein, 5 aa, Artificial
  CDR1 sequence
SYDMG

SEQ ID NO: 717 - protein, 5 aa, Artificial
  CDR1 sequence
GYWMS

SEQ ID NO: 718 - protein, 5 aa, Artificial
  CDR1 sequence
GYTMG

SEQ ID NO: 719 - protein, 5 aa, Artificial
  CDR1 sequence
GYWMS

SEQ ID NO: 720 - protein, 5 aa, Artificial
  CDR1 sequence
GYWMT

SEQ ID NO: 721 - protein, 5 aa, Artificial
  CDR1 sequence
GYWMS

SEQ ID NO: 722 - protein, 5 aa, Artificial
  CDR1 sequence
SSFMA

SEQ ID NO: 723 - protein, 5 aa, Artificial
  CDR1 sequence
RYGMG

SEQ ID NO: 724 - protein, 5 aa, Artificial
  CDR1 sequence
AYTMG

SEQ ID NO: 725 - protein, 5 aa, Artificial
  CDR1 sequence
NYAIG

SEQ ID NO: 726 - protein, 5 aa, Artificial
  CDR1 sequence
NYMVG

SEQ ID NO: 727 - protein, 6 aa, Artificial
  CDR1 sequence
SYAMVG

SEQ ID NO: 728 - protein, 5 aa, Artificial
  CDR1 sequence
YQAMG

SEQ ID NO: 729 - protein, 5 aa, Artificial
  CDR1 sequence
RYTMG

SEQ ID NO: 730 - protein, 5 aa, Artificial
  CDR1 sequence
ADTMG

SEQ ID NO: 731 - protein, 5 aa, Artificial
  CDR1 sequence
PIAMG

SEQ ID NO: 732 - protein, 5 aa, Artificial
  CDR1 sequence
TNHMG

SEQ ID NO: 733 - protein, 5 aa, Artificial
  CDR1 sequence
NYAMG

SEQ ID NO: 734 - protein, 5 aa, Artificial
  CDR1 sequence
SYAMG

SEQ ID NO: 735 - protein, 5 aa, Artificial
  CDR1 sequence
SSFMA

SEQ ID NO: 736 - protein, 5 aa, Artificial
  CDR1 sequence
SSFMA

SEQ ID NO: 737 - protein, 5 aa, Artificial
  CDR1 sequence
NGAMG

SEQ ID NO: 738 - protein, 5 aa, Artificial
  CDR1 sequence
AYTMG

SEQ ID NO: 739 - protein, 5 aa, Artificial
  CDR1 sequence
AYTMG

SEQ ID NO: 740 - protein, 5 aa, Artificial
  CDR1 sequence
NYMVG

SEQ ID NO: 741 - protein, 5 aa, Artificial
  CDR1 sequence
NYMVG

SEQ ID NO: 742 - protein, 5 aa, Artificial
  CDR1 sequence
NYAMG

SEQ ID NO: 743 - protein, 5 aa, Artificial
  CDR1 sequence
VYTMG

SEQ ID NO: 744 - protein, 5 aa, Artificial
  CDR1 sequence
SYWMY

SEQ ID NO: 745 - protein, 5 aa, Artificial
  CDR1 sequence
RYGMG

SEQ ID NO: 746 - protein, 5 aa, Artificial
  CDR1 sequence
INAMG

SEQ ID NO: 747 - protein, 5 aa, Artificial
  CDR1 sequence
INAMG

SEQ ID NO: 748 - protein, 5 aa, Artificial
  CDR1 sequence
SYAMG

SEQ ID NO: 749 - protein, 5 aa, Artificial
  CDR1 sequence
DYAIG

SEQ ID NO: 750 - protein, 5 aa, Artificial
  CDR1 sequence
SYAMG

SEQ ID NO: 751 - protein, 5 aa, Artificial
  CDR1 sequence
SVAMG

SEQ ID NO: 752 - protein, 5 aa, Artificial
  CDR1 sequence
SYAMG

SEQ ID NO: 753 - protein, 5 aa, Artificial
  CDR1 sequence
RYGMG

SEQ ID NO: 754 - protein, 5 aa, Artificial
  CDR1 sequence
PIAMG

SEQ ID NO: 755 - protein, 5 aa, Artificial
  CDR1 sequence
SVAMG

SEQ ID NO: 756 - protein, 6 aa, Artificial
  CDR1 sequence
SYAMVG

SEQ ID NO: 757 - protein, 5 aa, Artificial
  CDR1 sequence
YQAMG

SEQ ID NO: 758 - protein, 6 aa, Artificial
  CDR1 sequence
SYAMVG

SEQ ID NO: 759 - protein, 5 aa, Artificial
  CDR1 sequence
ITGMG

SEQ ID NO: 760 - protein, 5 aa, Artificial
  CDR1 sequence
LNAMG

SEQ ID NO: 761 - protein, 5 aa, Artificial
  CDR1 sequence
DYAMG

SEQ ID NO: 762 - protein, 5 aa, Artificial
  CDR1 sequence
AYTMG

SEQ ID NO: 763 - protein, 5 aa, Artificial
  CDR1 sequence
PYPMG

SEQ ID NO: 764 - protein, 5 aa, Artificial
  CDR1 sequence
HYAMS

SEQ ID NO: 765 - protein, 5 aa, Artificial
  CDR1 sequence
VNAMG

SEQ ID NO: 766 - protein, 5 aa, Artificial
  CDR1 sequence
YYAIG

SEQ ID NO: 767 - protein, 5 aa, Artificial
  CDR1 sequence
SYAMG

SEQ ID NO: 768 - protein, 5 aa, Artificial
  CDR1 sequence
SYAMG

SEQ ID NO: 769 - protein, 5 aa, Artificial
  CDR1 sequence
HYAMS

SEQ ID NO: 770 - protein, 5 aa, Artificial
  CDR1 sequence
TWVMG

SEQ ID NO: 771 - protein, 5 aa, Artificial
  CDR1 sequence
HYAMS

SEQ ID NO: 772 - protein, 5 aa, Artificial
  CDR1 sequence
LNTMG

SEQ ID NO: 773 - protein, 5 aa, Artificial
  CDR1 sequence
IFTMG

SEQ ID NO: 774 - protein, 5 aa, Artificial
  CDR1 sequence
ADTMG

SEQ ID NO: 775 - protein, 5 aa, Artificial
  CDR1 sequence
SYGMG

SEQ ID NO: 776 - protein, 3 aa, Artificial
  CDR1 sequence
TMG

SEQ ID NO: 777 - protein, 5 aa, Artificial
  CDR1 sequence
ADTMG

SEQ ID NO: 778 - protein, 5 aa, Artificial
  CDR1 sequence
INAMG

SEQ ID NO: 779 - protein, 5 aa, Artificial
  CDR1 sequence
INAMG

SEQ ID NO: 780 - protein, 5 aa, Artificial
  CDR1 sequence
NLAMG

SEQ ID NO: 781 - protein, 5 aa, Artificial
  CDR1 sequence
INAMA

SEQ ID NO: 782 - protein, 5 aa, Artificial
  CDR1 sequence
IFTMG

SEQ ID NO: 783 - protein, 5 aa, Artificial
  CDR1 sequence
INAMG

SEQ ID NO: 784 - protein, 5 aa, Artificial
  CDR1 sequence
ADTMG

SEQ ID NO: 785 - protein, 5 aa, Artificial
  CDR1 sequence
NYAMG

SEQ ID NO: 786 - protein, 5 aa, Artificial
  CDR1 sequence
INAMG

SEQ ID NO: 787 - protein, 5 aa, Artificial
  CDR1 sequence
INAMG

SEQ ID NO: 788 - protein, 5 aa, Artificial
  CDR1 sequence
RYGMG

SEQ ID NO: 789 - protein, 5 aa, Artificial
  CDR1 sequence
IDAMG

SEQ ID NO: 790 - protein, 5 aa, Artificial
  CDR1 sequence
LNAMG

SEQ ID NO: 791 - protein, 5 aa, Artificial
  CDR1 sequence
INAMG

SEQ ID NO: 792 - protein, 5 aa, Artificial
  CDR1 sequence
TNSVD

SEQ ID NO: 793 - protein, 5 aa, Artificial
  CDR1 sequence
SSFMA

SEQ ID NO: 794 - protein, 5 aa, Artificial
  CDR1 sequence
SSFMA

SEQ ID NO: 795 - protein, 5 aa, Artificial
  CDR1 sequence
TITMA

SEQ ID NO: 796 - protein, 5 aa, Artificial
  CDR1 sequence
SYAMG

SEQ ID NO: 797 - protein, 5 aa, Artificial
  CDR1 sequence
SYTMG

SEQ ID NO: 798 - protein, 5 aa, Artificial
  CDR1 sequence
HYAMS

SEQ ID NO: 799 - protein, 5 aa, Artificial
  CDR1 sequence
AYTMG

SEQ ID NO: 800 - protein, 5 aa, Artificial
  CDR1 sequence
SSFMA

SEQ ID NO: 801 - protein, 5 aa, Artificial
  CDR1 sequence
NSAAG

SEQ ID NO: 802 - protein, 5 aa, Artificial
  CDR1 sequence
DSDMS

SEQ ID NO: 803 - protein, 5 aa, Artificial
  CDR1 sequence
NSAAG

SEQ ID NO: 804 - protein, 5 aa, Artificial
  CDR1 sequence
RYGVG

SEQ ID NO: 805 - protein, 5 aa, Artificial
  CDR1 sequence
SYRMG

SEQ ID NO: 806 - protein, 5 aa, Artificial
  CDR1 sequence
PYVMA

SEQ ID NO: 807 - protein, 5 aa, Artificial
  CDR1 sequence
SYDMS

SEQ ID NO: 808 - protein, 6 aa, Artificial
  CDR1 sequence
SRVVAG

SEQ ID NO: 809 - protein, 5 aa, Artificial
  CDR1 sequence
PYVMA

SEQ ID NO: 810 - protein, 5 aa, Artificial
  CDR1 sequence
INAMG

SEQ ID NO: 811 - protein, 5 aa, Artificial
  CDR1 sequence
PYVMA

SEQ ID NO: 812 - protein, 5 aa, Artificial
  CDR1 sequence
SYIMG

SEQ ID NO: 813 - protein, 5 aa, Artificial
  CDR1 sequence
DYIMG

SEQ ID NO: 814 - protein, 5 aa, Artificial
  CDR1 sequence
SYIMG

SEQ ID NO: 815 - protein, 5 aa, Artificial
  CDR1 sequence
SYIMG

SEQ ID NO: 816 - protein, 5 aa, Artificial
  CDR1 sequence
TYGMG

SEQ ID NO: 817 - protein, 5 aa, Artificial
  CDR1 sequence
RSRMF

SEQ ID NO: 818 - protein, 5 aa, Artificial
  CDR1 sequence
RSRMF

SEQ ID NO: 819 - protein, 5 aa, Artificial
  CDR1 sequence
RSRMF

SEQ ID NO: 820 - protein, 5 aa, Artificial
  CDR1 sequence
QARMF

SEQ ID NO: 821 - protein, 5 aa, Artificial
  CDR1 sequence
QSRMF

SEQ ID NO: 822 - protein, 5 aa, Artificial
  CDR1 sequence
QSRMF

SEQ ID NO: 823 - protein, 5 aa, Artificial
  CDR1 sequence
QARMF

SEQ ID NO: 824 - protein, 5 aa, Artificial
  CDR1 sequence
QARMF

SEQ ID NO: 825 - protein, 5 aa, Artificial
  CDR1 sequence
QSRMF

SEQ ID NO: 826 - protein, 5 aa, Artificial
  CDR1 sequence
YYVIG

SEQ ID NO: 827 - protein, 5 aa, Artificial
  CDR1 sequence
YYALG

SEQ ID NO: 828 - protein, 5 aa, Artificial
  CDR1 sequence
YYVIG

SEQ ID NO: 829 - protein, 5 aa, Artificial
  CDR1 sequence
YYVIG

SEQ ID NO: 830 - protein, 5 aa, Artificial
  CDR1 sequence
YYAIG

SEQ ID NO: 831 - protein, 5 aa, Artificial
  CDR1 sequence
YYALG

SEQ ID NO: 832 - protein, 5 aa, Artificial
  CDR1 sequence
YYVIG

SEQ ID NO: 833 - protein, 5 aa, Artificial
  CDR1 sequence
YYAIG

SEQ ID NO: 834 - protein, 5 aa, Artificial
  CDR1 sequence
YYAIG

SEQ ID NO: 835 - protein, 5 aa, Artificial
  CDR1 sequence
YYVIG

SEQ ID NO: 836 - protein, 5 aa, Artificial
  CDR1 sequence
YYAIG

SEQ ID NO: 837 - protein, 5 aa, Artificial
  CDR1 sequence
YYVIG

SEQ ID NO: 838 - protein, 5 aa, Artificial
  CDR1 sequence
YYALG

SEQ ID NO: 839 - protein, 5 aa, Artificial
  CDR1 sequence
YYALG

SEQ ID NO: 840 - protein, 5 aa, Artificial
  CDR1 sequence
YYVIG

SEQ ID NO: 841 - protein, 5 aa, Artificial
  CDR1 sequence
YYVIG

SEQ ID NO: 842 - protein, 5 aa, Artificial
  CDR1 sequence
YYVIG

SEQ ID NO: 843 - protein, 5 aa, Artificial
  CDR1 sequence
YYALG

SEQ ID NO: 844 - protein, 5 aa, Artificial
  CDR1 sequence
YYALG

SEQ ID NO: 845 - protein, 5 aa, Artificial
  CDR1 sequence
YYAIG

SEQ ID NO: 846 - protein, 5 aa, Artificial
  CDR1 sequence
YYALG

SEQ ID NO: 847 - protein, 5 aa, Artificial
  CDR1 sequence
YYAIG

SEQ ID NO: 848 - protein, 5 aa, Artificial
  CDR1 sequence
YYALG

SEQ ID NO: 849 - protein, 5 aa, Artificial
  CDR1 sequence
YYVIG

SEQ ID NO: 850 - protein, 5 aa, Artificial
  CDR1 sequence
YYALG

SEQ ID NO: 851 - protein, 5 aa, Artificial
  CDR1 sequence
YYVIG

SEQ ID NO: 852 - protein, 5 aa, Artificial
  CDR1 sequence
YYVIG

SEQ ID NO: 853 - protein, 5 aa, Artificial
  CDR1 sequence
YYALG

SEQ ID NO: 854 - protein, 5 aa, Artificial
  CDR1 sequence
YYAIG

SEQ ID NO: 855 - protein, 5 aa, Artificial
  CDR1 sequence
YYAIG

SEQ ID NO: 856 - protein, 5 aa, Artificial
  CDR1 sequence
YYALG

SEQ ID NO: 857 - protein, 5 aa, Artificial
  CDR1 sequence
YYVIG

SEQ ID NO: 858 - protein, 5 aa, Artificial
  CDR1 sequence
YYALG

SEQ ID NO: 859 - protein, 5 aa, Artificial
  CDR1 sequence
YYALG

SEQ ID NO: 860 - protein, 5 aa, Artificial
  CDR1 sequence
YYALG

SEQ ID NO: 861 - protein, 5 aa, Artificial
  CDR1 sequence
YYAIG

SEQ ID NO: 862 - protein, 5 aa, Artificial
  CDR1 sequence
YYALG

SEQ ID NO: 863 - protein, 5 aa, Artificial
  CDR1 sequence
YYALG

SEQ ID NO: 864 - protein, 5 aa, Artificial
  CDR1 sequence
YYALG

SEQ ID NO: 865 - protein, 5 aa, Artificial
  CDR1 sequence
YYALG

SEQ ID NO: 866 - protein, 5 aa, Artificial
  CDR1 sequence
YYALG

SEQ ID NO: 867 - protein, 5 aa, Artificial
  CDR1 sequence
YYVIG

SEQ ID NO: 868 - protein, 5 aa, Artificial
  CDR1 sequence
YYVIG

SEQ ID NO: 869 - protein, 5 aa, Artificial
  CDR1 sequence
YYVIG

SEQ ID NO: 870 - protein, 5 aa, Artificial
  CDR1 sequence
YYVIG

SEQ ID NO: 871 - protein, 5 aa, Artificial
  CDR1 sequence
YYVIG

SEQ ID NO: 872 - protein, 5 aa, Artificial
  CDR1 sequence
YYVIG

SEQ ID NO: 873 - protein, 5 aa, Artificial
  CDR1 sequence
YYVIG

SEQ ID NO: 874 - protein, 5 aa, Artificial
  CDR1 sequence
YYVIG

SEQ ID NO: 875 - protein, 5 aa, Artificial
  CDR1 sequence
YYVIG

SEQ ID NO: 876 - protein, 5 aa, Artificial
  CDR1 sequence
YYVIG

SEQ ID NO: 877 - protein, 5 aa, Artificial
  CDR1 sequence
YYVIG

SEQ ID NO: 878 - protein, 5 aa, Artificial
  CDR1 sequence
YYVIG

SEQ ID NO: 879 - protein, 5 aa, Artificial
  CDR1 sequence
YYVIG

SEQ ID NO: 880 - protein, 5 aa, Artificial
  CDR1 sequence
DYAIG

SEQ ID NO: 881 - protein, 5 aa, Artificial
  CDR1 sequence
DYAIG

SEQ ID NO: 882 - protein, 5 aa, Artificial
  CDR1 sequence
DYAIG

SEQ ID NO: 883 - protein, 5 aa, Artificial
  CDR1 sequence
DYAIG

SEQ ID NO: 884 - protein, 5 aa, Artificial
  CDR1 sequence
DYAIG

SEQ ID NO: 885 - protein, 5 aa, Artificial
  CDR1 sequence
DYAIG

SEQ ID NO: 886 - protein, 5 aa, Artificial
  CDR1 sequence
DYAIG

SEQ ID NO: 887 - protein, 5 aa, Artificial
  CDR1 sequence
DYAIG

SEQ ID NO: 888 - protein, 5 aa, Artificial
  CDR1 sequence
DYAIG

SEQ ID NO: 889 - protein, 5 aa, Artificial
  CDR1 sequence
DYAIG

SEQ ID NO: 890 - protein, 5 aa, Artificial
  CDR1 sequence
DYAIG

SEQ ID NO: 891 - protein, 5 aa, Artificial
  CDR1 sequence
DYAIG

SEQ ID NO: 892 - protein, 5 aa, Artificial
  CDR1 sequence
SYAMG

SEQ ID NO: 893 - protein, 5 aa, Artificial
  CDR1 sequence
SYAMG

SEQ ID NO: 894 - protein, 5 aa, Artificial
  CDR1 sequence
SYAMG

SEQ ID NO: 895 - protein, 5 aa, Artificial
  CDR1 sequence
SYAMG

SEQ ID NO: 896 - protein, 5 aa, Artificial
  CDR1 sequence
SYAMG

SEQ ID NO: 897 - protein, 5 aa, Artificial
  CDR1 sequence
YYTAG

SEQ ID NO: 898 - protein, 5 aa, Artificial
  CDR1 sequence
NDAGG

SEQ ID NO: 899 - protein, 5 aa, Artificial
  CDR1 sequence
NDAGG

SEQ ID NO: 900 - protein, 5 aa, Artificial
  CDR1 sequence
NDAGG

SEQ ID NO: 901 - protein, 5 aa, Artificial
  CDR1 sequence
NDAGG

SEQ ID NO: 902 - protein, 5 aa, Artificial
  CDR1 sequence
ITSMG

SEQ ID NO: 903 - protein, 5 aa, Artificial
  CDR1 sequence
INAMG

SEQ ID NO: 904 - protein, 5 aa, Artificial
  CDR1 sequence
RYAMG

SEQ ID NO: 905 - protein, 5 aa, Artificial
  CDR1 sequence
RYAMG

SEQ ID NO: 906 - protein, 5 aa, Artificial
  CDR1 sequence
RYAMG

SEQ ID NO: 907 - protein, 5 aa, Artificial
  CDR1 sequence
RYAMG

SEQ ID NO: 908 - protein, 5 aa, Artificial
  CDR1 sequence
RYAMG

SEQ ID NO: 909 - protein, 5 aa, Artificial
  CDR1 sequence
RYAMG

SEQ ID NO: 910 - protein, 5 aa, Artificial
  CDR1 sequence
NYDIG

SEQ ID NO: 911 - protein, 5 aa, Artificial
  CDR1 sequence
NYDIG

SEQ ID NO: 912 - protein, 5 aa, Artificial
  CDR1 sequence
NYDIG

SEQ ID NO: 913 - protein, 5 aa, Artificial
  CDR1 sequence
YYAIG

SEQ ID NO: 914 - protein, 5 aa, Artificial
  CDR1 sequence
YYAIG

SEQ ID NO: 915 - protein, 5 aa, Artificial
  CDR1 sequence
RYIMG

SEQ ID NO: 916 - protein, 5 aa, Artificial
  CDR1 sequence
SRAMG

SEQ ID NO: 917 - protein, 5 aa, Artificial
  CDR1 sequence
RYAMG

SEQ ID NO: 918 - protein, 5 aa, Artificial
  CDR1 sequence
SYAMG

SEQ ID NO: 919 - protein, 5 aa, Artificial
  CDR1 sequence
RYAMG

SEQ ID NO: 920 - protein, 5 aa, Artificial
  CDR1 sequence
RYAMG

SEQ ID NO: 921 - protein, 5 aa, Artificial
  CDR1 sequence
RYAMG

SEQ ID NO: 922 - protein, 5 aa, Artificial
  CDR1 sequence
SYAMG

SEQ ID NO: 923 - protein, 5 aa, Artificial
  CDR1 sequence
SYAMG

SEQ ID NO: 924 - protein, 5 aa, Artificial
  CDR1 sequence
SYTMG

SEQ ID NO: 925 - protein, 5 aa, Artificial
  CDR1 sequence
HYYMG

SEQ ID NO: 926 - protein, 5 aa, Artificial
  CDR1 sequence
VYAMN

SEQ ID NO: 927 - protein, 5 aa, Artificial
  CDR1 sequence
NYPMG

SEQ ID NO: 928 - protein, 5 aa, Artificial
  CDR1 sequence
DYAIG

SEQ ID NO: 929 - protein, 5 aa, Artificial
  CDR1 sequence
SYAMG

SEQ ID NO: 930 - protein, 5 aa, Artificial
  CDR1 sequence
DYAIG

SEQ ID NO: 931 - protein, 5 aa, Artificial
  CDR1 sequence
NYAMY

SEQ ID NO: 932 - protein, 5 aa, Artificial
  CDR1 sequence
DYAIG

SEQ ID NO: 933 - protein, 5 aa, Artificial
  CDR1 sequence
ISVMG

SEQ ID NO: 934 - protein, 5 aa, Artificial
  CDR1 sequence
SSTMG

SEQ ID NO: 935 - protein, 5 aa, Artificial
  CDR1 sequence
NYVLG

SEQ ID NO: 936 - protein, 5 aa, Artificial
  CDR1 sequence
NYVLG

SEQ ID NO: 937 - protein, 5 aa, Artificial
  CDR1 sequence
YYAMG

SEQ ID NO: 938 - protein, 5 aa, Artificial
  CDR1 sequence
TSTMG

SEQ ID NO: 939 - protein, 5 aa, Artificial
  CDR1 sequence
SYGMG

SEQ ID NO: 940 - protein, 5 aa, Artificial
  CDR1 sequence
RYDMG

SEQ ID NO: 941 - protein, 5 aa, Artificial
  CDR1 sequence
RYDMG

SEQ ID NO: 942 - protein, 5 aa, Artificial
  CDR1 sequence
RYDMG

SEQ ID NO: 943 - protein, 5 aa, Artificial
  CDR1 sequence
RYDMG

SEQ ID NO: 944 - protein, 5 aa, Artificial
  CDR1 sequence
SIAMG

SEQ ID NO: 945 - protein, 5 aa, Artificial
  CDR1 sequence
SYTMG

SEQ ID NO: 946 - protein, 5 aa, Artificial
  CDR1 sequence
SSFMA

SEQ ID NO: 947 - protein, 5 aa, Artificial
  CDR1 sequence
NYAIG

SEQ ID NO: 948 - protein, 5 aa, Artificial
  CDR1 sequence
DYAIG

SEQ ID NO: 949 - protein, 5 aa, Artificial
  CDR1 sequence
SYTMG

SEQ ID NO: 950 - protein, 5 aa, Artificial
  CDR1 sequence
NLAMG

SEQ ID NO: 951 - protein, 5 aa, Artificial
  CDR1 sequence
SYWMY

SEQ ID NO: 952 - protein, 5 aa, Artificial
  CDR1 sequence
TYVMA

SEQ ID NO: 953 - protein, 5 aa, Artificial
  CDR1 sequence
YYAMG

SEQ ID NO: 954 - protein, 5 aa, Artificial
  CDR1 sequence
YYAIG

SEQ ID NO: 955 - protein, 6 aa, Artificial
  CDR1 sequence
FYDTAG

SEQ ID NO: 956 - protein, 5 aa, Artificial
  CDR1 sequence
SYGMG

SEQ ID NO: 957 - protein, 5 aa, Artificial
  CDR1 sequence
INFMN

SEQ ID NO: 958 - protein, 5 aa, Artificial
  CDR1 sequence
IATMA

SEQ ID NO: 959 - protein, 5 aa, Artificial
  CDR1 sequence
GYEMG

SEQ ID NO: 960 - protein, 5 aa, Artificial
  CDR1 sequence
GYEMG

SEQ ID NO: 961 - protein, 5 aa, Artificial
  CDR1 sequence
GYEMG

SEQ ID NO: 962 - protein, 5 aa, Artificial
  CDR1 sequence
GYEMG

SEQ ID NO: 963 - protein, 5 aa, Artificial
  CDR1 sequence
GYEMG

SEQ ID NO: 964 - protein, 5 aa, Artificial
  CDR1 sequence
TYAMG

SEQ ID NO: 965 - protein, 5 aa, Artificial
  CDR1 sequence
SNAMG

SEQ ID NO: 966 - protein, 5 aa, Artificial
  CDR1 sequence
SYDMG

SEQ ID NO: 967 - protein, 5 aa, Artificial
  CDR1 sequence
NYAMG

SEQ ID NO: 968 - protein, 5 aa, Artificial
  CDR1 sequence
SYAMG

SEQ ID NO: 969 - protein, 5 aa, Artificial
  CDR1 sequence
PYAMG

SEQ ID NO: 970 - protein, 5 aa, Artificial
  CDR1 sequence
SYAMG

SEQ ID NO: 971 - protein, 5 aa, Artificial
  CDR1 sequence
SYAMG

SEQ ID NO: 972 - protein, 14 aa, Artificial
  Framework sequence
WFRQAPGKEREFVA

SEQ ID NO: 973 - protein, 14 aa, Artificial
  Framework sequence
WFRQAPGKERDFVS

SEQ ID NO: 974 - protein, 14 aa, Artificial
  Framework sequence
WVRQAPGKGLEWVS

SEQ ID NO: 975 - protein, 14 aa, Artificial
  Framework sequence
WVRQAPGKGLEWVS

SEQ ID NO: 976 - protein, 14 aa, Artificial
  Framework sequence
WVRQAPGKGLEWVS

SEQ ID NO: 977 - protein, 14 aa, Artificial
  Framework sequence
WVRQAPGKGLEWVS

SEQ ID NO: 978 - protein, 14 aa, Artificial
  Framework sequence
WVRQAPGKGLEWVS

SEQ ID NO: 979 - protein, 14 aa, Artificial
  Framework sequence
WVRQAPGKGLEWVS

SEQ ID NO: 980 - protein, 14 aa, Artificial
  Framework sequence
WVRQAPGKGLEWVS

SEQ ID NO: 981 - protein, 14 aa, Artificial
  Framework sequence
WVRQAPGKGLEWVS

SEQ ID NO: 982 - protein, 14 aa, Artificial
  Framework sequence
WVRQAPGKGLEWVS

SEQ ID NO: 983 - protein, 14 aa, Artificial
  Framework sequence
WVRQAPGKGLEWVS

SEQ ID NO: 984 - protein, 14 aa, Artificial
  Framework sequence
WVRQTPGKDLEYVS

SEQ ID NO: 985 - protein, 14 aa, Artificial
  Framework sequence
WVRQAPGKGLEWVS

SEQ ID NO: 986 - protein, 14 aa, Artificial
  Framework sequence
WSRQAPGKQREWVA

SEQ ID NO: 987 - protein, 14 aa, Artificial
  Framework sequence
WVRQAPGKGLEWVS

SEQ ID NO: 988 - protein, 14 aa, Artificial
  Framework sequence
WVRQAPGKGLEWVS

SEQ ID NO: 989 - protein, 14 aa, Artificial
  Framework sequence
WVRQAPGKGLEWVS

SEQ ID NO: 990 - protein, 14 aa, Artificial
  Framework sequence
WVRQAPGKGLEWVS

SEQ ID NO: 991 - protein, 14 aa, Artificial
  Framework sequence
WVRQAPGKGLEWVS

SEQ ID NO: 992 - protein, 14 aa, Artificial
  Framework sequence
WFRQAPGKEREFVA

SEQ ID NO: 993 - protein, 14 aa, Artificial
  Framework sequence
WVRQAPGKGLEWVS

SEQ ID NO: 994 - protein, 14 aa, Artificial
  Framework sequence
WVRQAPGKGLEWVS

SEQ ID NO: 995 - protein, 14 aa, Artificial
  Framework sequence
WVRQAPGKGLEWVS

SEQ ID NO: 996 - protein, 14 aa, Artificial
  Framework sequence
WVRQAPGKGLEWVS

SEQ ID NO: 997 - protein, 14 aa, Artificial
  Framework sequence
WVRQAPGKGLEWVS

SEQ ID NO: 998 - protein, 14 aa, Artificial
  Framework sequence
WFRQAPGEERAFVG

SEQ ID NO: 999 - protein, 14 aa, Artificial
  Framework sequence
WVRQAPGKGLEWVS

SEQ ID NO: 1000 - protein, 14 aa, Artificial
  Framework sequence
WFRQAPGKGREWVA

SEQ ID NO: 1001 - protein, 14 aa, Artificial
  Framework sequence
WVRQAPGKGLEWVS

SEQ ID NO: 1002 - protein, 14 aa, Artificial
  Framework sequence
WVRQAPGKGLEWVS

SEQ ID NO: 1003 - protein, 14 aa, Artificial
  Framework sequence
WVRQAPGKGLEWVS

SEQ ID NO: 1004 - protein, 14 aa, Artificial
  Framework sequence
WFRQVLGSDREFVG

SEQ ID NO: 1005 - protein, 14 aa, Artificial
  Framework sequence
WFRQAPGKEREFVA

SEQ ID NO: 1006 - protein, 14 aa, Artificial
  Framework sequence
WFRRAPGKERDFVA

SEQ ID NO: 1007 - protein, 14 aa, Artificial
  Framework sequence
WFRQAPGKEREGVS

SEQ ID NO: 1008 - protein, 14 aa, Artificial
  Framework sequence
WFRQAPGGERMFVA

SEQ ID NO: 1009 - protein, 14 aa, Artificial
  Framework sequence
WFRQAPGKEREFVA

SEQ ID NO: 1010 - protein, 14 aa, Artificial
  Framework sequence
WFRQAPGKEREFVA

SEQ ID NO: 1011 - protein, 14 aa, Artificial
  Framework sequence
WFRQAPGKEREFVA

SEQ ID NO: 1012 - protein, 14 aa, Artificial
  Framework sequence
WFRQAPGKEREFVA

SEQ ID NO: 1013 - protein, 14 aa, Artificial
  Framework sequence
WFRQAPGKEREFVA

SEQ ID NO: 1014 - protein, 14 aa, Artificial
  Framework sequence
WYRRAPGKQRELVG

SEQ ID NO: 1015 - protein, 14 aa, Artificial
  Framework sequence
WFRQAPGKEREFVA

SEQ ID NO: 1016 - protein, 14 aa, Artificial
  Framework sequence
WFRQTPGKEREFVA

SEQ ID NO: 1017 - protein, 14 aa, Artificial
  Framework sequence
WFRQALGSDREFVG

SEQ ID NO: 1018 - protein, 14 aa, Artificial
  Framework sequence
WFRQALGSDREFVG

SEQ ID NO: 1019 - protein, 14 aa, Artificial
  Framework sequence
WFRQAPGKEREFVA

SEQ ID NO: 1020 - protein, 14 aa, Artificial
  Framework sequence
WFRRAPGKERDFVA

SEQ ID NO: 1021 - protein, 14 aa, Artificial
  Framework sequence
WFRRAPGKERDFVA

SEQ ID NO: 1022 - protein, 14 aa, Artificial
  Framework sequence
WFRQAPGGERMFVA

SEQ ID NO: 1023 - protein, 14 aa, Artificial
  Framework sequence
WFRQAPGGERMFVA

SEQ ID NO: 1024 - protein, 14 aa, Artificial
  Framework sequence
WFRQAPGKEREFVA

SEQ ID NO: 1025 - protein, 14 aa, Artificial
  Framework sequence
WFRQAPMKEREFVA

SEQ ID NO: 1026 - protein, 14 aa, Artificial
  Framework sequence
WVRQAPGKGLEWVS

SEQ ID NO: 1027 - protein, 14 aa, Artificial
  Framework sequence
WFRQAPGKEREFVA

SEQ ID NO: 1028 - protein, 14 aa, Artificial
  Framework sequence
WFRQAPGKEREFVA

SEQ ID NO: 1029 - protein, 14 aa, Artificial
  Framework sequence
WFRQAPGKEREFVA

SEQ ID NO: 1030 - protein, 14 aa, Artificial
  Framework sequence
WFRQAPGKEREFVA

SEQ ID NO: 1031 - protein, 14 aa, Artificial
  Framework sequence
WFRQAPGKEREGVS

SEQ ID NO: 1032 - protein, 14 aa, Artificial
  Framework sequence
WFRQAPGKEREFVA

SEQ ID NO: 1033 - protein, 14 aa, Artificial
  Framework sequence
WFRQAPGKEREFVA

SEQ ID NO: 1034 - protein, 14 aa, Artificial
  Framework sequence
WFRQAPGKEREFVA

SEQ ID NO: 1035 - protein, 14 aa, Artificial
  Framework sequence
WFRQAPGKEREFVA

SEQ ID NO: 1036 - protein, 14 aa, Artificial
  Framework sequence
WFRQAPGKEREFVA

SEQ ID NO: 1037 - protein, 14 aa, Artificial
  Framework sequence
WFRQAPGKEREFVA

SEQ ID NO: 1038 - protein, 14 aa, Artificial
  Framework sequence
WFRQAPGKEREFVA

SEQ ID NO: 1039 - protein, 14 aa, Artificial
  Framework sequence
WFRQAPGKEREFVA

SEQ ID NO: 1040 - protein, 14 aa, Artificial
  Framework sequence
WFRQAPGKEREFVA

SEQ ID NO: 1041 - protein, 14 aa, Artificial
  Framework sequence
WYRQAPGNQRELVA

SEQ ID NO: 1042 - protein, 14 aa, Artificial
  Framework sequence
WYRQTPGKERELVA

SEQ ID NO: 1043 - protein, 14 aa, Artificial
  Framework sequence
WFRQAPGKEREFVA

SEQ ID NO: 1044 - protein, 14 aa, Artificial
  Framework sequence
WFRRAPGKERDFVA

SEQ ID NO: 1045 - protein, 14 aa, Artificial
  Framework sequence
WFRQAPGKEREFVG

SEQ ID NO: 1046 - protein, 14 aa, Artificial
  Framework sequence
WVRQAPGKGLEWVS

SEQ ID NO: 1047 - protein, 14 aa, Artificial
  Framework sequence
WHRQAPGKERELVA

SEQ ID NO: 1048 - protein, 14 aa, Artificial
  Framework sequence
WFRQAPGKEREGVS

SEQ ID NO: 1049 - protein, 14 aa, Artificial
  Framework sequence
WFRQTPGKEREFVA

SEQ ID NO: 1050 - protein, 14 aa, Artificial
  Framework sequence
WFRQTPGKEREFVA

SEQ ID NO: 1051 - protein, 14 aa, Artificial
  Framework sequence
WVRQAPGKGLEWVS

SEQ ID NO: 1052 - protein, 14 aa, Artificial
  Framework sequence
WFRQAPGKEREFVA

SEQ ID NO: 1053 - protein, 14 aa, Artificial
  Framework sequence
WVRQAPGKGLEWVS

SEQ ID NO: 1054 - protein, 14 aa, Artificial
  Framework sequence
WYRQAPGKQRELVA

SEQ ID NO: 1055 - protein, 14 aa, Artificial
  Framework sequence
WYRQAPGKQRELVA

SEQ ID NO: 1056 - protein, 14 aa, Artificial
  Framework sequence
WFRQAPGKEREFVA

SEQ ID NO: 1057 - protein, 14 aa, Artificial
  Framework sequence
WFRQAPGKEREFVA

SEQ ID NO: 1058 - protein, 14 aa, Artificial
  Framework sequence
WFRQAPGKEREFVA

SEQ ID NO: 1059 - protein, 14 aa, Artificial
  Framework sequence
WFRQAPGKEREFVA

SEQ ID NO: 1060 - protein, 14 aa, Artificial
  Framework sequence
WYRQAPGKQRDLVA

SEQ ID NO: 1061 - protein, 14 aa, Artificial
  Framework sequence
WYRQAPGKQRDLVA

SEQ ID NO: 1062 - protein, 14 aa, Artificial
  Framework sequence
WFRQARGKEREFVA

SEQ ID NO: 1063 - protein, 14 aa, Artificial
  Framework sequence
WHRQAPGKERELVA

SEQ ID NO: 1064 - protein, 14 aa, Artificial
  Framework sequence
WYRQAPGKQRELVA

SEQ ID NO: 1065 - protein, 14 aa, Artificial
  Framework sequence
WYRQAPGKQRELVA

SEQ ID NO: 1066 - protein, 14 aa, Artificial
  Framework sequence
WFRQAPGKEREFVA

SEQ ID NO: 1067 - protein, 14 aa, Artificial
  Framework sequence
WFRQAPGKEREFVA

SEQ ID NO: 1068 - protein, 14 aa, Artificial
  Framework sequence
WYRQALGKQRELVA

SEQ ID NO: 1069 - protein, 14 aa, Artificial
  Framework sequence
WYRQAPGKQRELVA

SEQ ID NO: 1070 - protein, 14 aa, Artificial
  Framework sequence
WFRQAPGKEREFVA

SEQ ID NO: 1071 - protein, 14 aa, Artificial
  Framework sequence
WYRQAPGKQRELVA

SEQ ID NO: 1072 - protein, 14 aa, Artificial
  Framework sequence
WYRQVPGKERELVV

SEQ ID NO: 1073 - protein, 14 aa, Artificial
  Framework sequence
WYRQAPGKQRELVA

SEQ ID NO: 1074 - protein, 14 aa, Artificial
  Framework sequence
WYRQIPGKQRDWVA

SEQ ID NO: 1075 - protein, 14 aa, Artificial
  Framework sequence
WFRQVLGSDREFVG

SEQ ID NO: 1076 - protein, 14 aa, Artificial
  Framework sequence
WFRQVLGSDREFVG

SEQ ID NO: 1077 - protein, 14 aa, Artificial
  Framework sequence
WFRQAPGKEREFVA

SEQ ID NO: 1078 - protein, 14 aa, Artificial
  Framework sequence
WFRQTPGKEREFVA

SEQ ID NO: 1079 - protein, 14 aa, Artificial
  Framework sequence
WFRQAPGKEREFVA

SEQ ID NO: 1080 - protein, 14 aa, Artificial
  Framework sequence
WVRQAPGKGLEWVS

SEQ ID NO: 1081 - protein, 14 aa, Artificial
  Framework sequence
WFRRAPGKERDFVA

SEQ ID NO: 1082 - protein, 14 aa, Artificial
  Framework sequence
WFRQALGSDREFLG

SEQ ID NO: 1083 - protein, 14 aa, Artificial
  Framework sequence
WYRATSETQRELVA

SEQ ID NO: 1084 - protein, 14 aa, Artificial
  Framework sequence
WVRQAPGEGPEWVA

SEQ ID NO: 1085 - protein, 14 aa, Artificial
  Framework sequence
WYRATSETQRELVA

SEQ ID NO: 1086 - protein, 14 aa, Artificial
  Framework sequence
WFRQAPGKERELVA

SEQ ID NO: 1087 - protein, 14 aa, Artificial
  Framework sequence
WFRQAPGKEREFIS

SEQ ID NO: 1088 - protein, 14 aa, Artificial
  Framework sequence
WFRQAPGNEREFVA

SEQ ID NO: 1089 - protein, 14 aa, Artificial
  Framework sequence
WVRQAPGKGPEWVS

SEQ ID NO: 1090 - protein, 14 aa, Artificial
  Framework sequence
WFRQAPGKEREFVA

SEQ ID NO: 1091 - protein, 14 aa, Artificial
  Framework sequence
WFRQAPGNEREFVA

SEQ ID NO: 1092 - protein, 14 aa, Artificial
  Framework sequence
WYRQAPGKLRELVA

SEQ ID NO: 1093 - protein, 14 aa, Artificial
  Framework sequence
WFRQAPGNEREFVA

SEQ ID NO: 1094 - protein, 14 aa, Artificial
  Framework sequence
WFRQAPGKERMFVA

SEQ ID NO: 1095 - protein, 14 aa, Artificial
  Framework sequence
WFRQAPGKERMFIA

SEQ ID NO: 1096 - protein, 14 aa, Artificial
  Framework sequence
WFRQAPGKERMFIA

SEQ ID NO: 1097 - protein, 14 aa, Artificial
  Framework sequence
WFRQAPGKERMFIA

SEQ ID NO: 1098 - protein, 14 aa, Artificial
  Framework sequence
WFRQAAGKEREFAV

SEQ ID NO: 1099 - protein, 14 aa, Artificial
  Framework sequence
WARQAPGKGFEWLS

SEQ ID NO: 1100 - protein, 14 aa, Artificial
  Framework sequence
WARQAPGKGFEWLS

SEQ ID NO: 1101 - protein, 14 aa, Artificial
  Framework sequence
WARQAPGKGFEWLS

SEQ ID NO: 1102 - protein, 14 aa, Artificial
  Framework sequence
WARQAPGKGFEWLS

SEQ ID NO: 1103 - protein, 14 aa, Artificial
  Framework sequence
WARQAPGKGFEWLS

SEQ ID NO: 1104 - protein, 14 aa, Artificial
  Framework sequence
WARQAPGKGFEWLS

SEQ ID NO: 1105 - protein, 14 aa, Artificial
  Framework sequence
WARQAPGKGFEWLS

SEQ ID NO: 1106 - protein, 14 aa, Artificial
  Framework sequence
WARQAPGKGFEWLS

SEQ ID NO: 1107 - protein, 14 aa, Artificial
  Framework sequence
WARQAPGKGFEWLS

SEQ ID NO: 1108 - protein, 14 aa, Artificial
  Framework sequence
WFRQAPGKEREGLS

SEQ ID NO: 1109 - protein, 14 aa, Artificial
  Framework sequence
WFRQAPGKEREGVS

SEQ ID NO: 1110 - protein, 14 aa, Artificial
  Framework sequence
WFRQAPGKEREGLS

SEQ ID NO: 1111 - protein, 14 aa, Artificial
  Framework sequence
WFRQAPGKEREGLS

SEQ ID NO: 1112 - protein, 14 aa, Artificial
  Framework sequence
WFRQAPGKEREGVS

SEQ ID NO: 1113 - protein, 14 aa, Artificial
  Framework sequence
WFRQAPGKEREGVS

SEQ ID NO: 1114 - protein, 14 aa, Artificial
  Framework sequence
WFRQAPGKEREGLS

SEQ ID NO: 1115 - protein, 14 aa, Artificial
  Framework sequence
WFRQAPGKEREGVS

SEQ ID NO: 1116 - protein, 14 aa, Artificial
  Framework sequence
WFRQAPGKEREGVS

SEQ ID NO: 1117 - protein, 14 aa, Artificial
  Framework sequence
WFRQAPGKEREGVS

SEQ ID NO: 1118 - protein, 14 aa, Artificial
  Framework sequence
WFRQAPGKEREGVS

SEQ ID NO: 1119 - protein, 14 aa, Artificial
  Framework sequence
WFRQAPGKEREGLS

SEQ ID NO: 1120 - protein, 14 aa, Artificial
  Framework sequence
WFRQAPGKEREGVS

SEQ ID NO: 1121 - protein, 14 aa, Artificial
  Framework sequence
WFRQAPGKEREGVS

SEQ ID NO: 1122 - protein, 14 aa, Artificial
  Framework sequence
WFRQAPGKEREGVS

SEQ ID NO: 1123 - protein, 14 aa, Artificial
  Framework sequence
WFRQAPGKEREGLS

SEQ ID NO: 1124 - protein, 14 aa, Artificial
  Framework sequence
WFRQAPGKEREGLS

SEQ ID NO: 1125 - protein, 14 aa, Artificial
  Framework sequence
WFRQAPGKEREGVS

SEQ ID NO: 1126 - protein, 14 aa, Artificial
  Framework sequence
WFRQAPGKEREGVS

SEQ ID NO: 1127 - protein, 14 aa, Artificial
  Framework sequence
WFRQAPGKEREGVS

SEQ ID NO: 1128 - protein, 14 aa, Artificial
  Framework sequence
WFRQAPGKEREGVS

SEQ ID NO: 1129 - protein, 14 aa, Artificial
  Framework sequence
WFRQAPGKEREGVS

SEQ ID NO: 1130 - protein, 14 aa, Artificial
  Framework sequence
WFRQAPGKEREGVA

SEQ ID NO: 1131 - protein, 14 aa, Artificial
  Framework sequence
WFRQAPGKEREGLS

SEQ ID NO: 1132 - protein, 14 aa, Artificial
  Framework sequence
WFRQAPGKEREGVS

SEQ ID NO: 1133 - protein, 14 aa, Artificial
  Framework sequence
WFRQAPGKEREGVS

SEQ ID NO: 1134 - protein, 14 aa, Artificial
  Framework sequence
WFRQAPGKEREGVS

SEQ ID NO: 1135 - protein, 14 aa, Artificial
  Framework sequence
WFRQAPGKEREGVS

SEQ ID NO: 1136 - protein, 14 aa, Artificial
  Framework sequence
WFRQAPGKEREGVS

SEQ ID NO: 1137 - protein, 14 aa, Artificial
  Framework sequence
WFRQAPGKEREGVS

SEQ ID NO: 1138 - protein, 14 aa, Artificial
  Framework sequence
WFRQAPGKEREGVS

SEQ ID NO: 1139 - protein, 14 aa, Artificial
  Framework sequence
WFRQAPGKEREGLS

SEQ ID NO: 1140 - protein, 14 aa, Artificial
  Framework sequence
WFRQAPGKEREGVS

SEQ ID NO: 1141 - protein, 14 aa, Artificial
  Framework sequence
WFRQAPGKEREGVS

SEQ ID NO: 1142 - protein, 14 aa, Artificial
  Framework sequence
WFRQAPGKEREGVS

SEQ ID NO: 1143 - protein, 14 aa, Artificial
  Framework sequence
WFRQAPGKEREGVS

SEQ ID NO: 1144 - protein, 14 aa, Artificial
  Framework sequence
WFRQAPGKEREGVS

SEQ ID NO: 1145 - protein, 14 aa, Artificial
  Framework sequence
WFRQAPGKGREGVS

SEQ ID NO: 1146 - protein, 14 aa, Artificial
  Framework sequence
WFRQAPGKEREGVS

SEQ ID NO: 1147 - protein, 14 aa, Artificial
  Framework sequence
WFRQAPGKEREGVS

SEQ ID NO: 1148 - protein, 14 aa, Artificial
  Framework sequence
WFRQAPGKEREGVS

SEQ ID NO: 1149 - protein, 14 aa, Artificial
  Framework sequence
WFRQAPGKEREGVS

SEQ ID NO: 1150 - protein, 14 aa, Artificial
  Framework sequence
WFRQAPGKEREGVS

SEQ ID NO: 1151 - protein, 14 aa, Artificial
  Framework sequence
WFRQAPGKEREGVS

SEQ ID NO: 1152 - protein, 14 aa, Artificial
  Framework sequence
WFRQAPGKEREGVS

SEQ ID NO: 1153 - protein, 14 aa, Artificial
  Framework sequence
WFRQAPGKEREGLS

SEQ ID NO: 1154 - protein, 14 aa, Artificial
  Framework sequence
WFRQAPGKEREGVS

SEQ ID NO: 1155 - protein, 14 aa, Artificial
  Framework sequence
WFRQAPGKEREGVS

SEQ ID NO: 1156 - protein, 14 aa, Artificial
  Framework sequence
WFRQVPGKEREGVS

SEQ ID NO: 1157 - protein, 14 aa, Artificial
  Framework sequence
WFRQAPGKEREGVS

SEQ ID NO: 1158 - protein, 14 aa, Artificial
  Framework sequence
WFRQAPGKEREGVS

SEQ ID NO: 1159 - protein, 14 aa, Artificial
  Framework sequence
WFRQAPGKEREGVS

SEQ ID NO: 1160 - protein, 14 aa, Artificial
  Framework sequence
WFRQAPGKEREGVS

SEQ ID NO: 1161 - protein, 14 aa, Artificial
  Framework sequence
WFRQAPGKEREGVS

SEQ ID NO: 1162 - protein, 14 aa, Artificial
  Framework sequence
WFRQAPGKEREAVS

SEQ ID NO: 1163 - protein, 14 aa, Artificial
  Framework sequence
WFRQAPGKEREAVS

SEQ ID NO: 1164 - protein, 14 aa, Artificial
  Framework sequence
WFRQAPGKEREAVS

SEQ ID NO: 1165 - protein, 14 aa, Artificial
  Framework sequence
WFRQAPGKEREAVS

SEQ ID NO: 1166 - protein, 14 aa, Artificial
  Framework sequence
WFRQAPGKEREAVS

SEQ ID NO: 1167 - protein, 14 aa, Artificial
  Framework sequence
WFRQAPGKEREAVS

SEQ ID NO: 1168 - protein, 14 aa, Artificial
  Framework sequence
WFRQAPGKEREAVS

SEQ ID NO: 1169 - protein, 14 aa, Artificial
  Framework sequence
WFRQAPGKEREAVS

SEQ ID NO: 1170 - protein, 14 aa, Artificial
  Framework sequence
WFRQAPGKEREGVS

SEQ ID NO: 1171 - protein, 14 aa, Artificial
  Framework sequence
WFRQAPGKEREAVS

SEQ ID NO: 1172 - protein, 14 aa, Artificial
  Framework sequence
WFRQAPGKEREAVS

SEQ ID NO: 1173 - protein, 14 aa, Artificial
  Framework sequence
WFRQAPGKEREGVS

SEQ ID NO: 1174 - protein, 14 aa, Artificial
  Framework sequence
WFRQAPGKEREFVG

SEQ ID NO: 1175 - protein, 14 aa, Artificial
  Framework sequence
WFRQAPGKEREFVG

SEQ ID NO: 1176 - protein, 14 aa, Artificial
  Framework sequence
WFRQAPGKEREFVG

SEQ ID NO: 1177 - protein, 14 aa, Artificial
  Framework sequence
WFRQAPGKEREFVG

SEQ ID NO: 1178 - protein, 14 aa, Artificial
  Framework sequence
WFRQAPGKEREFVG

SEQ ID NO: 1179 - protein, 14 aa, Artificial
  Framework sequence
WFRQAPGKEREFVA

SEQ ID NO: 1180 - protein, 14 aa, Artificial
  Framework sequence
WFRQAPGKEREFVA

SEQ ID NO: 1181 - protein, 14 aa, Artificial
  Framework sequence
WFRQAPGKERDFVA

SEQ ID NO: 1182 - protein, 14 aa, Artificial
  Framework sequence
WFRQAPGKERDFVA

SEQ ID NO: 1183 - protein, 14 aa, Artificial
  Framework sequence
WFRQAPGKERDFVA

SEQ ID NO: 1184 - protein, 14 aa, Artificial
  Framework sequence
WYRQAAGKQRELVA

SEQ ID NO: 1185 - protein, 14 aa, Artificial
  Framework sequence
WYRQVPGKERELVA

SEQ ID NO: 1186 - protein, 14 aa, Artificial
  Framework sequence
WFRQAPGKERESVA

SEQ ID NO: 1187 - protein, 14 aa, Artificial
  Framework sequence
WFRQAPGKERESVA

SEQ ID NO: 1188 - protein, 14 aa, Artificial
  Framework sequence
WFRQAPGKERESVA

SEQ ID NO: 1189 - protein, 14 aa, Artificial
  Framework sequence
WFRQAPGKERESVA

SEQ ID NO: 1190 - protein, 14 aa, Artificial
  Framework sequence
WFRQAPGKERESVA

SEQ ID NO: 1191 - protein, 14 aa, Artificial
  Framework sequence
WFRQAPGKERESVA

SEQ ID NO: 1192 - protein, 14 aa, Artificial
  Framework sequence
WFRQAPGKGREFVA

SEQ ID NO: 1193 - protein, 14 aa, Artificial
  Framework sequence
WFRQAPGKGREFVA

SEQ ID NO: 1194 - protein, 14 aa, Artificial
  Framework sequence
WFRQAPGKGREFVA

SEQ ID NO: 1195 - protein, 14 aa, Artificial
  Framework sequence
WFRQAPGKEREGVS

SEQ ID NO: 1196 - protein, 14 aa, Artificial
  Framework sequence
WFRQAPGKEREGVS

SEQ ID NO: 1197 - protein, 14 aa, Artificial
  Framework sequence
WFRQAPGKEREFVG

SEQ ID NO: 1198 - protein, 14 aa, Artificial
  Framework sequence
WFRQAPGKEREFVA

SEQ ID NO: 1199 - protein, 14 aa, Artificial
  Framework sequence
WFRQAPGKEREFVA

SEQ ID NO: 1200 - protein, 14 aa, Artificial
  Framework sequence
WFRQAPGKEREFVA

SEQ ID NO: 1201 - protein, 14 aa, Artificial
  Framework sequence
WFRQAPGKEREFVA

SEQ ID NO: 1202 - protein, 14 aa, Artificial
  Framework sequence
WFRQAPGKEREFVA

SEQ ID NO: 1203 - protein, 14 aa, Artificial
  Framework sequence
WFRQAPGKEHEFVA

SEQ ID NO: 1204 - protein, 14 aa, Artificial
  Framework sequence
WIRQAPGKEREFVA

SEQ ID NO: 1205 - protein, 14 aa, Artificial
  Framework sequence
WIRQAPGKEREFVA

SEQ ID NO: 1206 - protein, 14 aa, Artificial
  Framework sequence
WFRQAPGKEREFVA

SEQ ID NO: 1207 - protein, 14 aa, Artificial
  Framework sequence
WYRQAPKKEREFVA

SEQ ID NO: 1208 - protein, 14 aa, Artificial
  Framework sequence
WVRQAPGKGLEWVS

SEQ ID NO: 1209 - protein, 14 aa, Artificial
  Framework sequence
WFRQAPGKEREFVG

SEQ ID NO: 1210 - protein, 14 aa, Artificial
  Framework sequence
WFRQGPGKAREGVS

SEQ ID NO: 1211 - protein, 14 aa, Artificial
  Framework sequence
WFRQAPGEERDFVA

SEQ ID NO: 1212 - protein, 14 aa, Artificial
  Framework sequence
WFRQAPGKEREGVS

SEQ ID NO: 1213 - protein, 14 aa, Artificial
  Framework sequence
WVRQAPGKGLEWVS

SEQ ID NO: 1214 - protein, 14 aa, Artificial
  Framework sequence
WFRQAPGKEREGVS

SEQ ID NO: 1215 - protein, 14 aa, Artificial
  Framework sequence
WYRQAPEKRRELVA

SEQ ID NO: 1216 - protein, 14 aa, Artificial
  Framework sequence
WFRRAPGKEREFVA

SEQ ID NO: 1217 - protein, 14 aa, Artificial
  Framework sequence
WFRQAPGKEREFVA

SEQ ID NO: 1218 - protein, 14 aa, Artificial
  Framework sequence
WFRQAPGKEREFVA

SEQ ID NO: 1219 - protein, 14 aa, Artificial
  Framework sequence
WFRQAPGKEREGVS

SEQ ID NO: 1220 - protein, 14 aa, Artificial
  Framework sequence
WFRQAPGNEREFVA

SEQ ID NO: 1221 - protein, 14 aa, Artificial
  Framework sequence
WFRQAPGKEREFVA

SEQ ID NO: 1222 - protein, 14 aa, Artificial
  Framework sequence
WFRQAPGEERKFVA

SEQ ID NO: 1223 - protein, 14 aa, Artificial
  Framework sequence
WFRQAPGEERQFVA

SEQ ID NO: 1224 - protein, 14 aa, Artificial
  Framework sequence
WFRQAPGEERKFVA

SEQ ID NO: 1225 - protein, 14 aa, Artificial
  Framework sequence
WFRQAPGKEREFVA

SEQ ID NO: 1226 - protein, 14 aa, Artificial
  Framework sequence
WFRQAPGKEREFVA

SEQ ID NO: 1227 - protein, 14 aa, Artificial
  Framework sequence
WFRQAPGKEREFVA

SEQ ID NO: 1228 - protein, 14 aa, Artificial
  Framework sequence
WFRQVLGSDREFVG

SEQ ID NO: 1229 - protein, 14 aa, Artificial
  Framework sequence
WFRQVPGKEREGVS

SEQ ID NO: 1230 - protein, 14 aa, Artificial
  Framework sequence
WFRQAPGKEREGVS

SEQ ID NO: 1231 - protein, 14 aa, Artificial
  Framework sequence
WFRQAPGKEREFVA

SEQ ID NO: 1232 - protein, 14 aa, Artificial
  Framework sequence
WFRQARGKEREFVA

SEQ ID NO: 1233 - protein, 14 aa, Artificial
  Framework sequence
WVRQVPGKGLEWVS

SEQ ID NO: 1234 - protein, 14 aa, Artificial
  Framework sequence
WFRQAPGKERECVA

SEQ ID NO: 1235 - protein, 14 aa, Artificial
  Framework sequence
WFRQAPGKEREFVA

SEQ ID NO: 1236 - protein, 14 aa, Artificial
  Framework sequence
WFRQAPGKEREGVS

SEQ ID NO: 1237 - protein, 14 aa, Artificial
  Framework sequence
WYRQAPGKQRELVA

SEQ ID NO: 1238 - protein, 14 aa, Artificial
  Framework sequence
WFRQAPGKEREFVA

SEQ ID NO: 1239 - protein, 14 aa, Artificial
  Framework sequence
WYRQAPGKQRELVA

SEQ ID NO: 1240 - protein, 14 aa, Artificial
  Framework sequence
WYRQAPGKQRELVA

SEQ ID NO: 1241 - protein, 14 aa, Artificial
  Framework sequence
WFRQAPGRERAFVA

SEQ ID NO: 1242 - protein, 14 aa, Artificial
  Framework sequence
WFRQAPGKERAFVA

SEQ ID NO: 1243 - protein, 14 aa, Artificial
  Framework sequence
WFRQAPGKERAFVA

SEQ ID NO: 1244 - protein, 14 aa, Artificial
  Framework sequence
WFRQAPGKERAFVA

SEQ ID NO: 1245 - protein, 14 aa, Artificial
  Framework sequence
WFRQAPGKERAFVA

SEQ ID NO: 1246 - protein, 14 aa, Artificial
  Framework sequence
WVRQAPGKGLEWVS

SEQ ID NO: 1247 - protein, 14 aa, Artificial
  Framework sequence
WFRQAPGKEREFVA

SEQ ID NO: 1248 - protein, 14 aa, Artificial
  Framework sequence
WFRQAPGKEREFVA

SEQ ID NO: 1249 - protein, 14 aa, Artificial
  Framework sequence
WFRQAPGKEREFVA

SEQ ID NO: 1250 - protein, 14 aa, Artificial
  Framework sequence
WFRQAPGKEREFVA

SEQ ID NO: 1251 - protein, 14 aa, Artificial
  Framework sequence
WFRQAPGKEREFVA

SEQ ID NO: 1252 - protein, 14 aa, Artificial
  Framework sequence
WFRQAPGKERDFVA

SEQ ID NO: 1253 - protein, 14 aa, Artificial
  Framework sequence
WFRQAPGKEREFVA

SEQ ID NO: 1254 - protein, 17 aa, Artificial
  CDR2 sequence
AIYAIGGDVYYADSVKG

SEQ ID NO: 1255 - protein, 17 aa, Artificial
  CDR2 sequence
AITWSGGSTYYADSVKG

SEQ ID NO: 1256 - protein, 17 aa, Artificial
  CDR2 sequence
SINNIGEEAYYVDSVKG

SEQ ID NO: 1257 - protein, 17 aa, Artificial
  CDR2 sequence
AINNVGGDTYYADSVKG

SEQ ID NO: 1258 - protein, 17 aa, Artificial
  CDR2 sequence
AINNVGDEVYYADSVKG

SEQ ID NO: 1259 - protein, 17 aa, Artificial
  CDR2 sequence
AINNVGDEVYYADSVKG

SEQ ID NO: 1260 - protein, 17 aa, Artificial
  CDR2 sequence
AISNSGGETYYADSVKG

SEQ ID NO: 1261 - protein, 17 aa, Artificial
  CDR2 sequence
AINNLGGDTYYADSVKG

SEQ ID NO: 1262 - protein, 17 aa, Artificial
  CDR2 sequence
SINNIGEEAYYVDSVKG

SEQ ID NO: 1263 - protein, 17 aa, Artificial
  CDR2 sequence
AINNVGGDTYYADSVKG

SEQ ID NO: 1264 - protein, 17 aa, Artificial
  CDR2 sequence
SINNIGEEAYYVDSVKG

SEQ ID NO: 1265 - protein, 17 aa, Artificial
  CDR2 sequence
AINNVGDETYYANSVKG

SEQ ID NO: 1266 - protein, 17 aa, Artificial
  CDR2 sequence
GISPSGSNTDYADSVKG

SEQ ID NO: 1267 - protein, 17 aa, Artificial
  CDR2 sequence
AINNVGGETYYADSVKG

SEQ ID NO: 1268 - protein, 16 aa, Artificial
  CDR2 sequence
SISSAGTIRYVDSVKG

SEQ ID NO: 1269 - protein, 17 aa, Artificial
  CDR2 sequence
AINNLGGDTYYADSVKG

SEQ ID NO: 1270 - protein, 17 aa, Artificial
  CDR2 sequence
AINNVGDEVYYADSVKG

SEQ ID NO: 1271 - protein, 17 aa, Artificial
  CDR2 sequence
AINNVGDEVYYADSVKG

SEQ ID NO: 1272 - protein, 17 aa, Artificial
  CDR2 sequence
SIANDGKSTYYVDSVKG

SEQ ID NO: 1273 - protein, 17 aa, Artificial
  CDR2 sequence
SINNIGEETYYVDSVKG

SEQ ID NO: 1274 - protein, 17 aa, Artificial
  CDR2 sequence
AISWSGRTTYYADFVKG

SEQ ID NO: 1275 - protein, 17 aa, Artificial
  CDR2 sequence
AINNVGGETYYADSVKG

SEQ ID NO: 1276 - protein, 17 aa, Artificial
  CDR2 sequence
AINNLGGDTYYADSVKG

SEQ ID NO: 1277 - protein, 17 aa, Artificial
  CDR2 sequence
AINNVGGDTYYADSVKG

SEQ ID NO: 1278 - protein, 17 aa, Artificial
  CDR2 sequence
SINNIGEEAYYVDSVKG

SEQ ID NO: 1279 - protein, 17 aa, Artificial
  CDR2 sequence
SINNIGEEAYYVDSVKG

SEQ ID NO: 1280 - protein, 16 aa, Artificial
  CDR2 sequence
AISRSGDVRYVDPVKG

SEQ ID NO: 1281 - protein, 17 aa, Artificial
  CDR2 sequence
AINNVGGETYYADSVKG

SEQ ID NO: 1282 - protein, 17 aa, Artificial
  CDR2 sequence
GISWSGDSTYYADSVKG

SEQ ID NO: 1283 - protein, 17 aa, Artificial
  CDR2 sequence
AINNLGGDTYYADSVKG

SEQ ID NO: 1284 - protein, 17 aa, Artificial
  CDR2 sequence
SINNIGEEVYYVDSVKG

SEQ ID NO: 1285 - protein, 17 aa, Artificial
  CDR2 sequence
AINNVGGDTYYADSVKG

SEQ ID NO: 1286 - protein, 17 aa, Artificial
  CDR2 sequence
GISPGGRFTYYADSRKG

SEQ ID NO: 1287 - protein, 18 aa, Artificial
  CDR2 sequence
AVSRLSGPRTVYADSVKG

SEQ ID NO: 1288 - protein, 17 aa, Artificial
  CDR2 sequence
AMNWNGGNTIYADSAKG

SEQ ID NO: 1289 - protein, 17 aa, Artificial
  CDR2 sequence
CINSGGSITDYLDSVKG

SEQ ID NO: 1290 - protein, 14 aa, Artificial
  CDR2 sequence
AISDTAYYADSVKG

SEQ ID NO: 1291 - protein, 18 aa, Artificial
  CDR2 sequence
AVTRWSGARTVYADSVKG

SEQ ID NO: 1292 - protein, 18 aa, Artificial
  CDR2 sequence
VVTRWSGARTVYADSVKG

SEQ ID NO: 1293 - protein, 17 aa, Artificial
  CDR2 sequence
AISWSDDSTYYRDSVKG

SEQ ID NO: 1294 - protein, 17 aa, Artificial
  CDR2 sequence
TIPWSGGIAYYSDSVKG

SEQ ID NO: 1295 - protein, 18 aa, Artificial
  CDR2 sequence
VVTRWSGARTVYADSVKG

SEQ ID NO: 1296 - protein, 16 aa, Artificial
  CDR2 sequence
TINRGDSPYYADSVKG

SEQ ID NO: 1297 - protein, 18 aa, Artificial
  CDR2 sequence
VVTRWSGGRTVYADSVKG

SEQ ID NO: 1298 - protein, 17 aa, Artificial
  CDR2 sequence
SISWIGKFTYYADSVKG

SEQ ID NO: 1299 - protein, 17 aa, Artificial
  CDR2 sequence
GISPGGRITYYADSRKG

SEQ ID NO: 1300 - protein, 17 aa, Artificial
  CDR2 sequence
GISPGGRITYYADSRKG

SEQ ID NO: 1301 - protein, 17 aa, Artificial
  CDR2 sequence
SISWSGGSTYYADSVKG

SEQ ID NO: 1302 - protein, 17 aa, Artificial
  CDR2 sequence
AMNWNGGNTIYADSAKG

SEQ ID NO: 1303 - protein, 17 aa, Artificial
  CDR2 sequence
AMNWNGGNTIYADSAKG

SEQ ID NO: 1304 - protein, 14 aa, Artificial
  CDR2 sequence
AISDTAYYADSVKG

SEQ ID NO: 1305 - protein, 14 aa, Artificial
  CDR2 sequence
AISDTAYYADSVKG

SEQ ID NO: 1306 - protein, 18 aa, Artificial
  CDR2 sequence
VVTRWSGGRTVYADSVKG

SEQ ID NO: 1307 - protein, 15 aa, Artificial
  CDR2 sequence
AISGGSIRYADSVKG

SEQ ID NO: 1308 - protein, 17 aa, Artificial
  CDR2 sequence
AISTGGGDTHYADSVKG

SEQ ID NO: 1309 - protein, 18 aa, Artificial
  CDR2 sequence
AVSRLSGPRTVYADSVKG

SEQ ID NO: 1310 - protein, 18 aa, Artificial
  CDR2 sequence
VVTRWSGARTVYADSVKG

SEQ ID NO: 1311 - protein, 18 aa, Artificial
  CDR2 sequence
VVTRWSGARTVYADSVKG

SEQ ID NO: 1312 - protein, 18 aa, Artificial
  CDR2 sequence
AVSRWSGPRTVYADSVKG

SEQ ID NO: 1313 - protein, 17 aa, Artificial
  CDR2 sequence
CIRCSDGSTYYADSVKG

SEQ ID NO: 1314 - protein, 18 aa, Artificial
  CDR2 sequence
AVSGWIGPRPVYADSVKG

SEQ ID NO: 1315 - protein, 18 aa, Artificial
  CDR2 sequence
ALSRWSGARTVYADSVKG

SEQ ID NO: 1316 - protein, 18 aa, Artificial
  CDR2 sequence
VVTRWSGGRTVYABSVKG

SEQ ID NO: 1317 - protein, 18 aa, Artificial
  CDR2 sequence
AVSRLSGPRTVYADSVKG

SEQ ID NO: 1318 - protein, 18 aa, Artificial
  CDR2 sequence
VVTRWSGARTVYADSVKG

SEQ ID NO: 1319 - protein, 18 aa, Artificial
  CDR2 sequence
AVSRWSGARTVYADSVKG

SEQ ID NO: 1320 - protein, 18 aa, Artificial
  CDR2 sequence
AVTRWSGARTVYADSVKG

SEQ ID NO: 1321 - protein, 18 aa, Artificial
  CDR2 sequence
VVTRWSGARTVYADSVKG

SEQ ID NO: 1322 - protein, 18 aa, Artificial
  CDR2 sequence
AVTRWSGARTVYADSVKG

SEQ ID NO: 1323 - protein, 16 aa, Artificial
  CDR2 sequence
QISHYDSTMYADSVKG

SEQ ID NO: 1324 - protein, 16 aa, Artificial
  CDR2 sequence
RITSLGPIMYAEFVKG

SEQ ID NO: 1325 - protein, 17 aa, Artificial
  CDR2 sequence
GISWAGHNTVYAGSMKG

SEQ ID NO: 1326 - protein, 17 aa, Artificial
  CDR2 sequence
AMNWNGGNTIYADSAKG

SEQ ID NO: 1327 - protein, 17 aa, Artificial
  CDR2 sequence
AISGGGFPTFYADSVKG

SEQ ID NO: 1328 - protein, 17 aa, Artificial
  CDR2 sequence
DITHGGLSTTYRDSVKG

SEQ ID NO: 1329 - protein, 16 aa, Artificial
  CDR2 sequence
QLTVFGSLNYADSVKG

SEQ ID NO: 1330 - protein, 17 aa, Artificial
  CDR2 sequence
CISSSDSSTYYADSVKG

SEQ ID NO: 1331 - protein, 17 aa, Artificial
  CDR2 sequence
SISWIGKFTYYADSVKG

SEQ ID NO: 1332 - protein, 17 aa, Artificial
  CDR2 sequence
SISWIGKFTYYADSVKG

SEQ ID NO: 1333 - protein, 17 aa, Artificial
  CDR2 sequence
DITNGGLSTTYRDSVKG

SEQ ID NO: 1334 - protein, 17 aa, Artificial
  CDR2 sequence
RIDWGGSSTSYADIVKG

SEQ ID NO: 1335 - protein, 17 aa, Artificial
  CDR2 sequence
BITHGGLTTTYRDSVKG

SEQ ID NO: 1336 - protein, 16 aa, Artificial
  CDR2 sequence
TLSIFGVSDYADSVKG

SEQ ID NO: 1337 - protein, 16 aa, Artificial
  CDR2 sequence
DITTGGSTNYADSVKG

SEQ ID NO: 1338 - protein, 17 aa, Artificial
  CDR2 sequence
TIPWSGGIAYYSDSVKG

SEQ ID NO: 1339 - protein, 18 aa, Artificial
  CDR2 sequence
AVSRLSGPRTVYADSVKG

SEQ ID NO: 1340 - protein, 17 aa, Artificial
  CDR2 sequence
TIPWSGGIPYYSDSVKG

SEQ ID NO: 1341 - protein, 17 aa, Artificial
  CDR2 sequence
TIPWSGGIAYYSDSVKG

SEQ ID NO: 1342 - protein, 16 aa, Artificial
  CDR2 sequence
HITFGGSSYYADSVKG

SEQ ID NO: 1343 - protein, 16 aa, Artificial
  CDR2 sequence
HITFGGNSYYADSVKG

SEQ ID NO: 1344 - protein, 17 aa, Artificial
  CDR2 sequence
TISWSHPNTYYTDSVKG

SEQ ID NO: 1345 - protein, 16 aa, Artificial
  CDR2 sequence
HISSGGSTYYGDFVKG

SEQ ID NO: 1346 - protein, 16 aa, Artificial
  CDR2 sequence
DITTGGSTNYADSVKG

SEQ ID NO: 1347 - protein, 16 aa, Artificial
  CDR2 sequence
HISSGGSTYYGDSVKG

SEQ ID NO: 1348 - protein, 17 aa, Artificial
  CDR2 sequence
TIPWSGGIAYYSDSVKG

SEQ ID NO: 1349 - protein, 18 aa, Artificial
  CDR2 sequence
VVTRWSGGRTVYADSVKG

SEQ ID NO: 1350 - protein, 16 aa, Artificial
  CDR2 sequence
TIGNGGNTNYADSAKG

SEQ ID NO: 1351 - protein, 16 aa, Artificial
  CDR2 sequence
HITSGGSTNYADSVKG

SEQ ID NO: 1352 - protein, 18 aa, Artificial
  CDR2 sequence
AVSRLSGPRTVYADSVKG

SEQ ID NO: 1353 - protein, 16 aa, Artificial
  CDR2 sequence
AITSGGNTNYADSVKG

SEQ ID NO: 1354 - protein, 18 aa, Artificial
  CDR2 sequence
SISSGGSTTYADSVKGRG

SEQ ID NO: 1355 - protein, 16 aa, Artificial
  CDR2 sequence
TIGNGGNTNYADSAKG

SEQ ID NO: 1356 - protein, 16 aa, Artificial
  CDR2 sequence
TITPSPYTYYADSVKG

SEQ ID NO: 1357 - protein, 17 aa, Artificial
  CDR2 sequence
GISPGGRFTYYADSRKG

SEQ ID NO: 1358 - protein, 17 aa, Artificial
  CDR2 sequence
GISPGGRFTYYADSRKG

SEQ ID NO: 1359 - protein, 17 aa, Artificial
  CDR2 sequence
VISWGGITTSYADSVKG

SEQ ID NO: 1360 - protein, 17 aa, Artificial
  CDR2 sequence
SISWIGEFIYYADSVKG

SEQ ID NO: 1361 - protein, 17 aa, Artificial
  CDR2 sequence
SISRDGGTPYYAYSVKG

SEQ ID NO: 1362 - protein, 17 aa, Artificial
  CDR2 sequence
DITNGGLSTTYRDSVKG

SEQ ID NO: 1363 - protein, 17 aa, Artificial
  CDR2 sequence
AMNWNGGNTIYADSAKG

SEQ ID NO: 1364 - protein, 17 aa, Artificial
  CDR2 sequence
GISPGSRFTYYADSGKG

SEQ ID NO: 1365 - protein, 16 aa, Artificial
  CDR2 sequence
RIRSSGSTNYADSVKG

SEQ ID NO: 1366 - protein, 17 aa, Artificial
  CDR2 sequence
GINSGGGSTVYADSVKG

SEQ ID NO: 1367 - protein, 16 aa, Artificial
  CDR2 sequence
RIRSSGSTNYADSVKG

SEQ ID NO: 1368 - protein, 17 aa, Artificial
  CDR2 sequence
SVDWSGSRTYYADSVKG

SEQ ID NO: 1369 - protein, 17 aa, Artificial
  CDR2 sequence
TISWNGRSTYYADSVKG

SEQ ID NO: 1370 - protein, 17 aa, Artificial
  CDR2 sequence
RIRWSGGDAYYDDSVKG

SEQ ID NO: 1371 - protein, 17 aa, Artificial
  CDR2 sequence
GINSGGGSTGYADSVKG

SEQ ID NO: 1372 - protein, 17 aa, Artificial
  CDR2 sequence
AISWDGVQTYYTDSVEG

SEQ ID NO: 1373 - protein, 17 aa, Artificial
  CDR2 sequence
RIRWSGGDAYYDDSVKG

SEQ ID NO: 1374 - protein, 16 aa, Artificial
  CDR2 sequence
AFRTGGSTDYADSVKG

SEQ ID NO: 1375 - protein, 17 aa, Artificial
  CDR2 sequence
RIRWSGGDAYYDDSVKG

SEQ ID NO: 1376 - protein, 17 aa, Artificial
  CDR2 sequence
AISGTGTIKYYGDLVKG

SEQ ID NO: 1377 - protein, 17 aa, Artificial
  CDR2 sequence
AISGTGTIKYYGDLVRG

SEQ ID NO: 1378 - protein, 17 aa, Artificial
  CDR2 sequence
AISGTGTIKYYGDLVGG

SEQ ID NO: 1379 - protein, 17 aa, Artificial
  CDR2 sequence
AISGTGTIKYYGDLVGG

SEQ ID NO: 1380 - protein, 17 aa, Artificial
  CDR2 sequence
AISRSGANIYYGTSTQG

SEQ ID NO: 1381 - protein, 16 aa, Artificial
  CDR2 sequence
SILTAGDTWYSDSVKG

SEQ ID NO: 1382 - protein, 16 aa, Artificial
  CDR2 sequence
SILTAGDTWYSDSVKG

SEQ ID NO: 1383 - protein, 16 aa, Artificial
  CDR2 sequence
SILTAGDTWYSDSVKG

SEQ ID NO: 1384 - protein, 16 aa, Artificial
  CDR2 sequence
SILTAGDTWYSDSVKG

SEQ ID NO: 1385 - protein, 16 aa, Artificial
  CDR2 sequence
SILTAGDTWYSDSVKG

SEQ ID NO: 1386 - protein, 16 aa, Artificial
  CDR2 sequence
SILTAGDTWHSDSVKG

SEQ ID NO: 1387 - protein, 16 aa, Artificial
  CDR2 sequence
SILTAGDTWYSDSVKG

SEQ ID NO: 1388 - protein, 16 aa, Artificial
  CDR2 sequence
SILTAGDTWYSDSVKG

SEQ ID NO: 1389 - protein, 16 aa, Artificial
  CDR2 sequence
SILTAGDTWYSDSVKG

SEQ ID NO: 1390 - protein, 16 aa, Artificial
  CDR2 sequence
CISSDGSTTYADSVKG

SEQ ID NO: 1391 - protein, 17 aa, Artificial
  CDR2 sequence
CISSVDHSTTYADSVKG

SEQ ID NO: 1392 - protein, 17 aa, Artificial
  CDR2 sequence
CISSSDGSTTYADSVKG

SEQ ID NO: 1393 - protein, 17 aa, Artificial
  CDR2 sequence
CISSSDGSTTYADSVKG

SEQ ID NO: 1394 - protein, 17 aa, Artificial
  CDR2 sequence
CISSSDHSTTYADSVKG

SEQ ID NO: 1395 - protein, 17 aa, Artificial
  CDR2 sequence
CISSSDHSTTYTDSVKG

SEQ ID NO: 1396 - protein, 16 aa, Artificial
  CDR2 sequence
CISSDGSTTYADSVKG

SEQ ID NO: 1397 - protein, 17 aa, Artificial
  CDR2 sequence
CISSVDHSTTYADSVKG

SEQ ID NO: 1398 - protein, 17 aa, Artificial
  CDR2 sequence
CISSSDGSTTYADLVKG

SEQ ID NO: 1399 - protein, 16 aa, Artificial
  CDR2 sequence
CISSDGTTTYPDSVKG

SEQ ID NO: 1400 - protein, 17 aa, Artificial
  CDR2 sequence
CISSSDGSTTYADSVKG

SEQ ID NO: 1401 - protein, 16 aa, Artificial
  CDR2 sequence
CISSDGLTTYADSVKG

SEQ ID NO: 1402 - protein, 17 aa, Artificial
  CDR2 sequence
CISSADHSTTYADSVKG

SEQ ID NO: 1403 - protein, 17 aa, Artificial
  CDR2 sequence
CISSADHSTTYADSVKG

SEQ ID NO: 1404 - protein, 17 aa, Artificial
  CDR2 sequence
CISSSDGSTTYADFVKG

SEQ ID NO: 1405 - protein, 16 aa, Artificial
  CDR2 sequence
CISSDGSTTYADSVKG

SEQ ID NO: 1406 - protein, 16 aa, Artificial
  CDR2 sequence
CISSDGSTTYADSVKG

SEQ ID NO: 1407 - protein, 17 aa, Artificial
  CDR2 sequence
CISSVDHSTTYADSVKG

SEQ ID NO: 1408 - protein, 17 aa, Artificial
  CDR2 sequence
CISSSDHSTTYADSVKG

SEQ ID NO: 1409 - protein, 17 aa, Artificial
  CDR2 sequence
CISSTDHSTTYADSVKG

SEQ ID NO: 1410 - protein, 17 aa, Artificial
  CDR2 sequence
CISSSDHTTTYADSVKG

SEQ ID NO: 1411 - protein, 17 aa, Artificial
  CDR2 sequence
CISSSDGSTTYADSVKG

SEQ ID NO: 1412 - protein, 17 aa, Artificial
  CDR2 sequence
CIDSSDHSTTYADSVKG

SEQ ID NO: 1413 - protein, 16 aa, Artificial
  CDR2 sequence
CISSDGSTTYADSVKG

SEQ ID NO: 1414 - protein, 17 aa, Artificial
  CDR2 sequence
CISSSDHSTTYTDSVKG

SEQ ID NO: 1415 - protein, 17 aa, Artificial
  CDR2 sequence
CISSSDGSTTYADFVKG

SEQ ID NO: 1416 - protein, 17 aa, Artificial
  CDR2 sequence
CISSSDGSTTYADFVKG

SEQ ID NO: 1417 - protein, 17 aa, Artificial
  CDR2 sequence
CISSVDHSTTYADSVKG

SEQ ID NO: 1418 - protein, 17 aa, Artificial
  CDR2 sequence
CISSVDHSTTYADPVKG

SEQ ID NO: 1419 - protein, 17 aa, Artificial
  CDR2 sequence
CISSSDHSTTYADSVKG

SEQ ID NO: 1420 - protein, 17 aa, Artificial
  CDR2 sequence
CISSVDHSTTYADSVKG

SEQ ID NO: 1421 - protein, 16 aa, Artificial
  CDR2 sequence
CISSDGLTTYADSVKG

SEQ ID NO: 1422 - protein, 17 aa, Artificial
  CDR2 sequence
CISSSDHSTTYADSVKG

SEQ ID NO: 1423 - protein, 18 aa, Artificial
  CDR2 sequence
CISSVDHSTTYADSVKGQ

SEQ ID NO: 1424 - protein, 17 aa, Artificial
  CDR2 sequence
CISSSDHSTTYADSVKG

SEQ ID NO: 1425 - protein, 17 aa, Artificial
  CDR2 sequence
CISSSDGSTTYADSVKG

SEQ ID NO: 1426 - protein, 17 aa, Artificial
  CDR2 sequence
CISSSDHTTTYADSVKG

SEQ ID NO: 1427 - protein, 17 aa, Artificial
  CDR2 sequence
CISSSDHTTTYADSVKG

SEQ ID NO: 1428 - protein, 17 aa, Artificial
  CDR2 sequence
CISSSDHTTTYADSVKG

SEQ ID NO: 1429 - protein, 17 aa, Artificial
  CDR2 sequence
CISSSDHTTTYTDSVKG

SEQ ID NO: 1430 - protein, 17 aa, Artificial
  CDR2 sequence
CISSSDHTTTYADSVKG

SEQ ID NO: 1431 - protein, 17 aa, Artificial
  CDR2 sequence
CMSSSGDITTYAPSVKG

SEQ ID NO: 1432 - protein, 17 aa, Artificial
  CDR2 sequence
CMSSSGDSTTYADSVKG

SEQ ID NO: 1433 - protein, 17 aa, Artificial
  CDR2 sequence
CMSSSGDSTTYADSVKG

SEQ ID NO: 1434 - protein, 17 aa, Artificial
  CDR2 sequence
CMSSSGDSTTYADSVKG

SEQ ID NO: 1435 - protein, 17 aa, Artificial
  CDR2 sequence
CMSSSGDSTTYADSVKG

SEQ ID NO: 1436 - protein, 17 aa, Artificial
  CDR2 sequence
CMSSSGDSTTYADSVKG

SEQ ID NO: 1437 - protein, 17 aa, Artificial
  CDR2 sequence
CMSSSGDSTTYADSVKG

SEQ ID NO: 1438 - protein, 17 aa, Artificial
  CDR2 sequence
CMSSSGDSTTYADSVKG

SEQ ID NO: 1439 - protein, 17 aa, Artificial
  CDR2 sequence
CMSSSGDSTTYAPSVKG

SEQ ID NO: 1440 - protein, 17 aa, Artificial
  CDR2 sequence
CMSSSGDSTTYADSVKG

SEQ ID NO: 1441 - protein, 17 aa, Artificial
  CDR2 sequence
CMSSSGDSTTYADSVQG

SEQ ID NO: 1442 - protein, 17 aa, Artificial
  CDR2 sequence
CMSSSGDITTYAPSVKG

SEQ ID NO: 1443 - protein, 17 aa, Artificial
  CDR2 sequence
CMSSSGDITTYAPSVKG

SEQ ID NO: 1444 - protein, 17 aa, Artificial
  CDR2 sequence
CISSSDGTTYYADSVKG

SEQ ID NO: 1445 - protein, 17 aa, Artificial
  CDR2 sequence
CISSSDGSTYYTDSVKG

SEQ ID NO: 1446 - protein, 17 aa, Artificial
  CDR2 sequence
CISSSDGSTYYADSVKG

SEQ ID NO: 1447 - protein, 17 aa, Artificial
  CDR2 sequence
CISSSDSSTYYTDSVKG

SEQ ID NO: 1448 - protein, 17 aa, Artificial
  CDR2 sequence
CISSSDGVTYYSDSVKG

SEQ ID NO: 1449 - protein, 17 aa, Artificial
  CDR2 sequence
CISSSDGSTYYTDSVKG

SEQ ID NO: 1450 - protein, 17 aa, Artificial
  CDR2 sequence
CISSSDGSTYYADSVKG

SEQ ID NO: 1451 - protein, 17 aa, Artificial
  CDR2 sequence
CISSSDGTTYYADSVKG

SEQ ID NO: 1452 - protein, 17 aa, Artificial
  CDR2 sequence
CIDSSDGSTYYADSVKG

SEQ ID NO: 1453 - protein, 17 aa, Artificial
  CDR2 sequence
CISSSDGTTYYADSVKG

SEQ ID NO: 1454 - protein, 16 aa, Artificial
  CDR2 sequence
CISSSDGTYYADSVKG

SEQ ID NO: 1455 - protein, 17 aa, Artificial
  CDR2 sequence
CIDSSDGSTYYADSVKG

SEQ ID NO: 1456 - protein, 17 aa, Artificial
  CDR2 sequence
AISGSGSNIYYANSMPG

SEQ ID NO: 1457 - protein, 17 aa, Artificial
  CDR2 sequence
AISGSGSNIYYANAMPG

SEQ ID NO: 1458 - protein, 17 aa, Artificial
  CDR2 sequence
AISGSGSNIYYADSMPG

SEQ ID NO: 1459 - protein, 17 aa, Artificial
  CDR2 sequence
AISESGSNIYYANAMPG

SEQ ID NO: 1460 - protein, 17 aa, Artificial
  CDR2 sequence
AISGSGSNIYYANSMPG

SEQ ID NO: 1461 - protein, 17 aa, Artificial
  CDR2 sequence
SISRSSGSTRYADSVRG

SEQ ID NO: 1462 - protein, 16 aa, Artificial
  CDR2 sequence
AITSGGSTDYANSVKG

SEQ ID NO: 1463 - protein, 16 aa, Artificial
  CDR2 sequence
AITSGGSTDYANSVKG

SEQ ID NO: 1464 - protein, 16 aa, Artificial
  CDR2 sequence
AITSGGSTDYANSVKG

SEQ ID NO: 1465 - protein, 16 aa, Artificial
  CDR2 sequence
AITSGGSTDYANSVKG

SEQ ID NO: 1466 - protein, 16 aa, Artificial
  CDR2 sequence
KIISGGSTNYADSVKG

SEQ ID NO: 1467 - protein, 16 aa, Artificial
  CDR2 sequence
VMRNPGGTNYADSVKG

SEQ ID NO: 1468 - protein, 18 aa, Artificial
  CDR2 sequence
AISSSGDNIYYADSVKGQ

SEQ ID NO: 1469 - protein, 19 aa, Artificial
  CDR2 sequence
AISSSGDNIYYSRSVKGIL

SEQ ID NO: 1470 - protein, 18 aa, Artificial
  CDR2 sequence
AISSSGDNIYYADSVKGQ

SEQ ID NO: 1471 - protein, 18 aa, Artificial
  CDR2 sequence
AISSSGDNIYYPDSVKGQ

SEQ ID NO: 1472 - protein, 19 aa, Artificial
  CDR2 sequence
AISSSGDNIYYSRSVKGIL

SEQ ID NO: 1473 - protein, 18 aa, Artificial
  CDR2 sequence
AISSSGDNIYYADSVKGQ

SEQ ID NO: 1474 - protein, 17 aa, Artificial
  CDR2 sequence
RISSAGSNLYYGSSMPG

SEQ ID NO: 1475 - protein, 17 aa, Artificial
  CDR2 sequence
RISSGGSNIYYGNSMPG

SEQ ID NO: 1476 - protein, 17 aa, Artificial
  CDR2 sequence
RISSAGSNLYYGTSMPG

SEQ ID NO: 1477 - protein, 17 aa, Artificial
  CDR2 sequence
CISSWDGSTYYADSVKG

SEQ ID NO: 1478 - protein, 17 aa, Artificial
  CDR2 sequence
CISSWDGSTYYADSVKG

SEQ ID NO: 1479 - protein, 17 aa, Artificial
  CDR2 sequence
AISRSGDITSFADFVKG

SEQ ID NO: 1480 - protein, 17 aa, Artificial
  CDR2 sequence
AINWIGNIPYYANSVKG

SEQ ID NO: 1481 - protein, 17 aa, Artificial
  CDR2 sequence
AISWSGGSTYYADSVKG

SEQ ID NO: 1482 - protein, 17 aa, Artificial
  CDR2 sequence
AISWSDGSTYYADSVKG

SEQ ID NO: 1483 - protein, 17 aa, Artificial
  CDR2 sequence
AISWSGGSTYYADSVKG

SEQ ID NO: 1484 - protein, 17 aa, Artificial
  CDR2 sequence
AISWSGGSTYYADSVKG

SEQ ID NO: 1485 - protein, 17 aa, Artificial
  CDR2 sequence
AISWSGGSTYYADSVKG

SEQ ID NO: 1486 - protein, 17 aa, Artificial
  CDR2 sequence
GIDQSGESTAYGTSASG

SEQ ID NO: 1487 - protein, 17 aa, Artificial
  CDR2 sequence
GIDQSGESTAYGASASG

SEQ ID NO: 1488 - protein, 17 aa, Artificial
  CDR2 sequence
AIHWSGSNIYYGNSMKG

SEQ ID NO: 1489 - protein, 16 aa, Artificial
  CDR2 sequence
DISRAGASRYADSVKG

SEQ ID NO: 1490 - protein, 17 aa, Artificial
  CDR2 sequence
GISFSGGATMYADSVKG

SEQ ID NO: 1491 - protein, 17 aa, Artificial
  CDR2 sequence
AISGSGSNLYYPGSWKG

SEQ ID NO: 1492 - protein, 17 aa, Artificial
  CDR2 sequence
CISSSDGSTYYADSVKG

SEQ ID NO: 1493 - protein, 17 aa, Artificial
  CDR2 sequence
AIGWSGNSPYYAQFVKG

SEQ ID NO: 1494 - protein, 17 aa, Artificial
  CDR2 sequence
CISNSDGSTYYADSVKG

SEQ ID NO: 1495 - protein, 17 aa, Artificial
  CDR2 sequence
AINSGGGSTGYTDSVKG

SEQ ID NO: 1496 - protein, 17 aa, Artificial
  CDR2 sequence
SISSSDGSPYYADSVKG

SEQ ID NO: 1497 - protein, 16 aa, Artificial
  CDR2 sequence
TITTFGITNYADSVKG

SEQ ID NO: 1498 - protein, 17 aa, Artificial
  CDR2 sequence
AISWNGGTHYADYFVKG

SEQ ID NO: 1499 - protein, 17 aa, Artificial
  CDR2 sequence
AISFRGDSAIGAPSVEG

SEQ ID NO: 1500 - protein, 17 aa, Artificial
  CDR2 sequence
AINWRGDITIGPPNVEG

SEQ ID NO: 1501 - protein, 17 aa, Artificial
  CDR2 sequence
CISSSDGSTYYADSVKG

SEQ ID NO: 1502 - protein, 17 aa, Artificial
  CDR2 sequence
CISWSGDITFYADSVKG

SEQ ID NO: 1503 - protein, 17 aa, Artificial
  CDR2 sequence
AITWSGGYTYYLDSVKG

SEQ ID NO: 1504 - protein, 17 aa, Artificial
  CDR2 sequence
GINWSGGRTYYADSVKG

SEQ ID NO: 1505 - protein, 17 aa, Artificial
  CDR2 sequence
GINWSGGRTYYADSVKG

SEQ ID NO: 1506 - protein, 17 aa, Artificial
  CDR2 sequence
GINWSGGRTYYADSVKG

SEQ ID NO: 1507 - protein, 17 aa, Artificial
  CDR2 sequence
GINWSGGRTYYADSVKG

SEQ ID NO: 1508 - protein, 17 aa, Artificial
  CDR2 sequence
AISWSRGRTFYADSVKG

SEQ ID NO: 1509 - protein, 17 aa, Artificial
  CDR2 sequence
CVSRDGGTTYYAYSVKG

SEQ ID NO: 1510 - protein, 17 aa, Artificial
  CDR2 sequence
GISPGGRFTYYADSRKG

SEQ ID NO: 1511 - protein, 17 aa, Artificial
  CDR2 sequence
CINSGGGRIDYADSVKG

SEQ ID NO: 1512 - protein, 17 aa, Artificial
  CDR2 sequence
CIRCNDGSTYYADSVKG

SEQ ID NO: 1513 - protein, 17 aa, Artificial
  CDR2 sequence
TIPWSGGIPYYSDSVKG

SEQ ID NO: 1514 - protein, 17 aa, Artificial
  CDR2 sequence
TISWSHPNTYYTDSVKG

SEQ ID NO: 1515 - protein, 17 aa, Artificial
  CDR2 sequence
AISTGGGDTHYQDSVKG

SEQ ID NO: 1516 - protein, 17 aa, Artificial
  CDR2 sequence
AINWSGENIYYADSVKG

SEQ ID NO: 1517 - protein, 17 aa, Artificial
  CDR2 sequence
TISRSGEWIYYKDAMKG

SEQ ID NO: 1518 - protein, 20 aa, Artificial
  CDR2 sequence
CFPSRYSSDGSTYYADSVKG

SEQ ID NO: 1519 - protein, 18 aa, Artificial
  CDR2 sequence
LITDISGGYIKYADSVKG

SEQ ID NO: 1520 - protein, 17 aa, Artificial
  CDR2 sequence
AISWSDSSTYYADSVKG

SEQ ID NO: 1521 - protein, 16 aa, Artificial
  CDR2 sequence
SITSGGYTNYADSVKG

SEQ ID NO: 1522 - protein, 16 aa, Artificial
  CDR2 sequence
SISSSGYRIYADSVKG

SEQ ID NO: 1523 - protein, 17 aa, Artificial
  CDR2 sequence
AISQSGGTTSYAVSVKG

SEQ ID NO: 1524 - protein, 17 aa, Artificial
  CDR2 sequence
AISQSGGTTSYAVSVKG

SEQ ID NO: 1525 - protein, 17 aa, Artificial
  CDR2 sequence
AISQSGGTTSYAVSVKG

SEQ ID NO: 1526 - protein, 17 aa, Artificial
  CDR2 sequence
AISQSGGTTSYAVSVKG

SEQ ID NO: 1527 - protein, 17 aa, Artificial
  CDR2 sequence
AISQSGGTTSYAVSVKG

SEQ ID NO: 1528 - protein, 17 aa, Artificial
  CDR2 sequence
CISNGGLRTMYADSVKG

SEQ ID NO: 1529 - protein, 18 aa, Artificial
  CDR2 sequence
AVTRWSGARTVYADSVKG

SEQ ID NO: 1530 - protein, 18 aa, Artificial
  CDR2 sequence
AVTRWSGARGVYADSVKG

SEQ ID NO: 1531 - protein, 18 aa, Artificial
  CDR2 sequence
VVSRWSGGRTLYADSVKG

SEQ ID NO: 1532 - protein, 17 aa, Artificial
  CDR2 sequence
AIWWSGGSTYYADSVKG

SEQ ID NO: 1533 - protein, 17 aa, Artificial
  CDR2 sequence
AISWSGGTTYYADSVKG

SEQ ID NO: 1534 - protein, 17 aa, Artificial
  CDR2 sequence
AISWSGGSTYYADSVKG

SEQ ID NO: 1535 - protein, 18 aa, Artificial
  CDR2 sequence
AISGWIGPRPVYADSVKG

SEQ ID NO: 1536 - protein, 32 aa, Artificial
  Framework sequence
RFTISRDNAKNTVYLQMSSLKPEDTAIYSCAV

SEQ ID NO: 1537 - protein, 32 aa, Artificial; identical to SEQ ID NO: 112
  Framework sequence

SEQ ID NO: 1538 - protein, 32 aa, Artificial
  Framework sequence
RFTISRDNAKNTLYLQMNSLKSEDTAVYYCVK

SEQ ID NO: 1539 - protein, 32 aa, Artificial
  Framework sequence
RFTISRDNAKNMLYLQMNSLKAEDTAVYYCAR

SEQ ID NO: 1540 - protein, 32 aa, Artificial
  Framework sequence
RFTISRDNAKNTLYLQMNSLKSEDTAVYYCTR

SEQ ID NO: 1541 - protein, 32 aa, Artificial; identical to SEQ ID NO: 1540
  Framework sequence

SEQ ID NO: 1542 - protein, 32 aa, Artificial
  Framework sequence
RFTISRDNAKNTLYLQMNSLRSEDTAVYYCTR

SEQ ID NO: 1543 - protein, 32 aa, Artificial; identical to SEQ ID NO: 1539
  Framework sequence

SEQ ID NO: 1544 - protein, 32 aa, Artificial; identical to SEQ ID NO: 1538
  Framework sequence

SEQ ID NO: 1545 - protein, 32 aa, Artificial; identical to SEQ ID NO: 1539
  Framework sequence

SEQ ID NO: 1546 - protein, 32 aa, Artificial; identical to SEQ ID NO: 1538
  Framework sequence

SEQ ID NO: 1547 - protein, 32 aa, Artificial
  Framework sequence
RFTIARDNTKRTLYLQMNSLKSEDTAVYYCTR

SEQ ID NO: 1548 - protein, 32 aa, Artificial
  Framework sequence
RFTISRDNAKNTLYLQMNSLKPEDTALYYCRR

SEQ ID NO: 1549 - protein, 32 aa, Artificial
  Framework sequence
RFTISRDNAKNALYLQMNSLKSEDTAVYYCAR

SEQ ID NO: 1550 - protein, 32 aa, Artificial
  Framework sequence
RFTISRDNAKNTGYLQMNSLKPEDTAVYYCYV

SEQ ID NO: 1551 - protein, 32 aa, Artificial; identical to SEQ ID NO: 1539
  Framework sequence

SEQ ID NO: 1552 - protein, 32 aa, Artificial; identical to SEQ ID NO: 1540
  Framework sequence

SEQ ID NO: 1553 - protein, 32 aa, Artificial; identical to SEQ ID NO: 1540
  Framework sequence

SEQ ID NO: 1554 - protein, 32 aa, Artificial
  Framework sequence
RFSISRDNAKNTLYLQMNSLKSEDTAVYYCVR

SEQ ID NO: 1555 - protein, 32 aa, Artificial; identical to SEQ ID NO: 1538
  Framework sequence

SEQ ID NO: 1556 - protein, 32 aa, Artificial; identical to SEQ ID NO: 112
  Framework sequence

SEQ ID NO: 1557 - protein, 32 aa, Artificial
  Framework sequence
RFTISRDNAKNTLYLQMNSLKSEDTAAYYCAR

SEQ ID NO: 1558 - protein, 32 aa, Artificial; identical to SEQ ID NO: 1539
  Framework sequence

SEQ ID NO: 1559 - protein, 32 aa, Artificial
  Framework sequence
RFTISRDNAKNTLYLQMNSLKSEDTAVYYCAR

SEQ ID NO: 1560 - protein, 32 aa, Artificial; identical to SEQ ID NO: 1538
  Framework sequence

SEQ ID NO: 1561 - protein, 32 aa, Artificial; identical to SEQ ID NO: 1538
  Framework sequence

SEQ ID NO: 1562 - protein, 32 aa, Artificial
  Framework sequence
RFTITRDNAKNTVYLQMNSLKPEDTAVYYCAA

SEQ ID NO: 1563 - protein, 32 aa, Artificial; identical to SEQ ID NO: 1557
  Framework sequence

SEQ ID NO: 1564 - protein, 32 aa, Artificial
  Framework sequence
RFTISREDAKNTVYLQMNSLKPGDTADYYCAA

SEQ ID NO: 1565 - protein, 32 aa, Artificial; identical to SEQ ID NO: 1539
  Framework sequence

SEQ ID NO: 1566 - protein, 32 aa, Artificial; identical to SEQ ID NO: 1538
  Framework sequence

SEQ ID NO: 1567 - protein, 32 aa, Artificial; identical to SEQ ID NO: 1539
  Framework sequence

SEQ ID NO: 1568 - protein, 32 aa, Artificial
  Framework sequence
RFTISGDNANNTVYLQMHSVKPEDTATYYCAA

SEQ ID NO: 1569 - protein, 32 aa, Artificial
  Framework sequence
RFTISRDNAENTVYLQMNSLKPEDTAVYTCAA

SEQ ID NO: 1570 - protein, 32 aa, Artificial
  Framework sequence
RFTISRDNAKNTVYLQMNSLKAEDTAVYYCAA

SEQ ID NO: 1571 - protein, 32 aa, Artificial
  Framework sequence
RFAISRDNAKSTVYLQMNSLKPEDTAVYYCAT

SEQ ID NO: 1572 - protein, 32 aa, Artificial
  Framework sequence
RFTISRDNAKNTVYLPMNSLKPEDTAVYYCAA

SEQ ID NO: 1573 - protein, 32 aa, Artificial; identical to SEQ ID NO: 1569
  Framework sequence

SEQ ID NO: 1574 - protein, 32 aa, Artificial; identical to SEQ ID NO: 1569
  Framework sequence

SEQ ID NO: 1575 - protein, 32 aa, Artificial
  Framework sequence
RFTISRDNAKKTVYLQMNTLKPEDTAVYYCAA

SEQ ID NO: 1576 - protein, 32 aa, Artificial
  Framework sequence
RFTMSRDNAKNTVDLQMNSLKPEDTALYYCAG

SEQ ID NO: 1577 - protein, 32 aa, Artificial; identical to SEQ ID NO: 1569
  Framework sequence

SEQ ID NO: 1578 - protein, 32 aa, Artificial
  Framework sequence
RFTISRDNAKNMVYLQMNSLKPEDTAVYYCNA

SEQ ID NO: 1579 - protein, 32 aa, Artificial; identical to SEQ ID NO: 1569
  Framework sequence

SEQ ID NO: 1580 - protein, 32 aa, Artificial
  Framework sequence
RFTISGENAKNTVYLQMNSLKPEDTAVYYCAA

SEQ ID NO: 1581 - protein, 32 aa, Artificial
  Framework sequence
RFTISRDNANNTVYLQMDSLKPEDTATYYCAA

SEQ ID NO: 1582 - protein, 32 aa, Artificial; identical to SEQ ID NO: 1581
  Framework sequence

SEQ ID NO: 1583 - protein, 32 aa, Artificial
  Framework sequence
RFTISGDNAKSTVYLQMNSLKPEDTAVYYCAV

SEQ ID NO: 1584 - protein, 32 aa, Artificial; identical to SEQ ID NO: 1570
  Framework sequence

SEQ ID NO: 1585 - protein, 32 aa, Artificial; identical to SEQ ID NO: 1570
  Framework sequence

SEQ ID NO: 1586 - protein, 32 aa, Artificial; identical to SEQ ID NO: 1572
  Framework sequence

SEQ ID NO: 1587 - protein, 32 aa, Artificial; identical to SEQ ID NO: 1572
  Framework sequence

SEQ ID NO: 1588 - protein, 32 aa, Artificial; identical to SEQ ID NO: 1569
  Framework sequence

SEQ ID NO: 1589 - protein, 32 aa, Artificial
  Framework sequence
RFAISSDNAGNTVYLQMNNLQPEDTAVYYCAA

SEQ ID NO: 1590 - protein, 32 aa, Artificial
  Framework sequence
RFTISRDNPKNTLYLQMNSLKPEDTALYYCAR

SEQ ID NO: 1591 - protein, 32 aa, Artificial; identical to SEQ ID NO: 1569
  Framework sequence

SEQ ID NO: 1592 - protein, 32 aa, Artificial; identical to SEQ ID NO: 1569
  Framework sequence

SEQ ID NO: 1593 - protein, 32 aa, Artificial; identical to SEQ ID NO: 1569
  Framework sequence

SEQ ID NO: 1594 - protein, 32 aa, Artificial; identical to SEQ ID NO: 1569
  Framework sequence

SEQ ID NO: 1595 - protein, 32 aa, Artificial
  Framework sequence
RFTISSDNAKNTVYLQMNSLKPEDTAVYYCAA

SEQ ID NO: 1596 - protein, 32 aa, Artificial
  Framework sequence
RFTISRDNAENTVYLQMNSLQPEDTAVYTCAA

SEQ ID NO: 1597 - protein, 32 aa, Artificial
  Framework sequence
RFTISGDNAENTVYLQMNSLKPEDTAVYTCAA

SEQ ID NO: 1598 - protein, 32 aa, Artificial; identical to SEQ ID NO: 1569
  Framework sequence

SEQ ID NO: 1599 - protein, 32 aa, Artificial; identical to SEQ ID NO: 1569
  Framework sequence

SEQ ID NO: 1600 - protein, 32 aa, Artificial; identical to SEQ ID NO: 1569
  Framework sequence

SEQ ID NO: 1601 - protein, 32 aa, Artificial; identical to SEQ ID NO: 1597
  Framework sequence

SEQ ID NO: 1602 - protein, 32 aa, Artificial; identical to SEQ ID NO: 1569
  Framework sequence

SEQ ID NO: 1603 - protein, 32 aa, Artificial; identical to SEQ ID NO: 1569
  Framework sequence

SEQ ID NO: 1604 - protein, 32 aa, Artificial; identical to SEQ ID NO: 1569
  Framework sequence

SEQ ID NO: 1605 - protein, 32 aa, Artificial
  Framework sequence
RFTISRDNAKNTVYLQMNSLKPEDTAVYYCNA

SEQ ID NO: 1606 - protein, 32 aa, Artificial
  Framework sequence
RFTISRDNDKNTVYLQMNSLKPEDTAVYYCKT

SEQ ID NO: 1607 - protein, 32 aa, Artificial
  Framework sequence
RFTVSRDNAENTLYLQMNSLESEDTAVYYCAK

SEQ ID NO: 1608 - protein, 32 aa, Artificial; identical to SEQ ID NO: 1570
  Framework sequence

SEQ ID NO: 1609 - protein, 32 aa, Artificial
  Framework sequence
RFTISRDNAENTVYLQMNSLKPEDTAVYFCAR

SEQ ID NO: 1610 - protein, 32 aa, Artificial
  Framework sequence
RFTISRDNAKNTLYLQMDSLKPEDTAVYYCSK

SEQ ID NO: 1611 - protein, 32 aa, Artificial
  Framework sequence
RFSISKDSAKNTVLLQMNSLKPEDTAVYSCNL

SEQ ID NO: 1612 - protein, 32 aa, Artificial; identical to SEQ ID NO: 112
  Framework sequence

SEQ ID NO: 1613 - protein, 32 aa, Artificial; identical to SEQ ID NO: 1580
  Framework sequence

SEQ ID NO: 1614 - protein, 32 aa, Artificial; identical to SEQ ID NO: 1580
  Framework sequence

SEQ ID NO: 1615 - protein, 32 aa, Artificial; identical to SEQ ID NO: 1610
  Framework sequence

SEQ ID NO: 1616 - protein, 32 aa, Artificial
  Framework sequence
RFTISRDNAKNTVYLQMNSLKPEDAAVYYCAA

SEQ ID NO: 1617 - protein, 32 aa, Artificial; identical to SEQ ID NO: 1610
  Framework sequence

SEQ ID NO: 1618 - protein, 32 aa, Artificial
  Framework sequence
RFTISRDNAKNMVYLQMNSLKPEDTALYFCKQ

SEQ ID NO: 1619 - protein, 32 aa, Artificial
  Framework sequence
RFTISSENAKNTVYLQMNSLKAEDTAVYYCNA

SEQ ID NO: 1620 - protein, 32 aa, Artificial; identical to SEQ ID NO: 1576
  Framework sequence

SEQ ID NO: 1621 - protein, 32 aa, Artificial; identical to SEQ ID NO: 1569
  Framework sequence

SEQ ID NO: 1622 - protein, 32 aa, Artificial
  Framework sequence
RFTMSRDNAKNTADLQMNSLKPEDTALYYCAG

SEQ ID NO: 1623 - protein, 32 aa, Artificial; identical to SEQ ID NO: 1576
  Framework sequence

SEQ ID NO: 1624 - protein, 32 aa, Artificial; identical to SEQ ID NO: 1605
  Framework sequence

SEQ ID NO: 1625 - protein, 32 aa, Artificial; identical to SEQ ID NO: 1605
  Framework sequence

SEQ ID NO: 1626 - protein, 32 aa, Artificial
  Framework sequence
RFTISRDDAKNAVYLQMNSLKPEDTAVYYCAA

SEQ ID NO: 1627 - protein, 32 aa, Artificial
  Framework sequence
RFTISRDNAKDTVYLQMNSLKPEDTAVYYCHV

SEQ ID NO: 1628 - protein, 32 aa, Artificial; identical to SEQ ID NO: 1619
  Framework sequence

SEQ ID NO: 1629 - protein, 32 aa, Artificial
  Framework sequence
RFTISRDNAKNTADLQMNSLKPEDTAVYYCNA

SEQ ID NO: 1630 - protein, 32 aa, Artificial; identical to SEQ ID NO: 1576
  Framework sequence

SEQ ID NO: 1631 - protein, 32 aa, Artificial; identical to SEQ ID NO: 1569
  Framework sequence

SEQ ID NO: 1632 - protein, 32 aa, Artificial
  Framework sequence
RFSISRHNAKNSVYLQMNSLKPEDTAVYFCNL

SEQ ID NO: 1633 - protein, 32 aa, Artificial
  Framework sequence
RFTISRDNAKNTVYLQMNSLKPEDTAVYYCNH

SEQ ID NO: 1634 - protein, 32 aa, Artificial; identical to SEQ ID NO: 1569
  Framework sequence

SEQ ID NO: 1635 - protein, 32 aa, Artificial
  Framework sequence
RFTISRDNAKNTVYLQMNSLKPEDTAVYYCNT

SEQ ID NO: 1636 - protein, 32 aa, Artificial
  Framework sequence
RFTISRDDAKNTVYLQMNSLKPEDTGVYYCNA

SEQ ID NO: 1637 - protein, 32 aa, Artificial; identical to SEQ ID NO: 1632
  Framework sequence

SEQ ID NO: 1638 - protein, 32 aa, Artificial
  Framework sequence
RFTISRDDAKNTVYLHMNSLKPEDTAVYYCKT

SEQ ID NO: 1639 - protein, 32 aa, Artificial; identical to SEQ ID NO: 1568
  Framework sequence

SEQ ID NO: 1640 - protein, 32 aa, Artificial; identical to SEQ ID NO: 1568
  Framework sequence

SEQ ID NO: 1641 - protein, 32 aa, Artificial
  Framework sequence
RFTISRDHAKNEQYLEMNSLKPEDTAVYFCTA

SEQ ID NO: 1642 - protein, 32 aa, Artificial
  Framework sequence
RFTISGENAKNTVYLQMNRLKPEDTAVYYCAA

SEQ ID NO: 1643 - protein, 32 aa, Artificial
  Framework sequence
RFTISRDNAKNTVYLQMNSLGPEDTAIYTCAA

SEQ ID NO: 1644 - protein, 32 aa, Artificial; identical to SEQ ID NO: 1610
  Framework sequence

SEQ ID NO: 1645 - protein, 32 aa, Artificial; identical to SEQ ID NO: 1570
  Framework sequence

SEQ ID NO: 1646 - protein, 32 aa, Artificial
  Framework sequence
RFTISRDNANNTVYLQMHSLKPEDTATYYCAA

SEQ ID NO: 1647 - protein, 32 aa, Artificial
  Framework sequence
RFTVSRDNAKNTVYLQMNSLKPEDTAVYYCNV

SEQ ID NO: 1648 - protein, 32 aa, Artificial
  Framework sequence
RFTISRDNAKNMLYLQMNSLKPEDTAVYLCAQ

SEQ ID NO: 1649 - protein, 32 aa, Artificial; identical to SEQ ID NO: 1647
  Framework sequence

SEQ ID NO: 1650 - protein, 32 aa, Artificial
  Framework sequence
RFTISRDNAKNTGYLQMNSLKPDDTAVYYCAA

SEQ ID NO: 1651 - protein, 32 aa, Artificial
  Framework sequence
RFIFSEDNAKNTVYLQMNSLKPEDTAVYYCAA

SEQ ID NO: 1652 - protein, 32 aa, Artificial
  Framework sequence
RFAITRDAAKNTVHLQMNSLKPEDTAVYYCAA

SEQ ID NO: 1653 - protein, 32 aa, Artificial
  Framework sequence
RFTISRDNAKNTLYLQMNSLKPEDTAVYYCST

SEQ ID NO: 1654 - protein, 32 aa, Artificial
  Framework sequence
RFTVSRDSAKITVFLQMDNLKPEDTAVYYCAA

SEQ ID NO: 1655 - protein, 32 aa, Artificial; identical to SEQ ID NO: 1652
  Framework sequence

SEQ ID NO: 1656 - protein, 32 aa, Artificial
  Framework sequence
RFTISRDTAKNTVYLQMNSLKPEDTAVYYCNA

SEQ ID NO: 1657 - protein, 32 aa, Artificial; identical to SEQ ID NO: 1652
  Framework sequence

SEQ ID NO: 1658 - protein, 32 aa, Artificial
  Framework sequence
RFTISRDNAKNTVYLQIDSLQPEDTAVYYCAA

SEQ ID NO: 1659 - protein, 32 aa, Artificial
  Framework sequence
RFTISRDNAKNTVYLRIDSLNPEDTAVYYCAA

SEQ ID NO: 1660 - protein, 32 aa, Artificial; identical to SEQ ID NO: 1659
  Framework sequence

SEQ ID NO: 1661 - protein, 32 aa, Artificial; identical to SEQ ID NO: 1659
  Framework sequence

SEQ ID NO: 1662 - protein, 32 aa, Artificial
  Framework sequence
RFTISRDNAKNTLYLQMNSLEPEDTAVYYCAA

SEQ ID NO: 1663 - protein, 32 aa, Artificial
  Framework sequence
RFTISRDNAKNTLYLQMNDLKSEDTAVYYCSK

SEQ ID NO: 1664 - protein, 32 aa, Artificial; identical to SEQ ID NO: 1663
  Framework sequence

SEQ ID NO: 1665 - protein, 32 aa, Artificial; identical to SEQ ID NO: 1663
  Framework sequence

SEQ ID NO: 1666 - protein, 32 aa, Artificial; identical to SEQ ID NO: 1663
  Framework sequence

SEQ ID NO: 1667 - protein, 32 aa, Artificial; identical to SEQ ID NO: 1663
  Framework sequence

SEQ ID NO: 1668 - protein, 32 aa, Artificial; identical to SEQ ID NO: 1663
  Framework sequence

SEQ ID NO: 1669 - protein, 32 aa, Artificial; identical to SEQ ID NO: 1663
  Framework sequence

SEQ ID NO: 1670 - protein, 32 aa, Artificial
  Framework sequence
RFIISRDNAKNTLYLQMNDLKSEDTAVYYCSK

SEQ ID NO: 1671 - protein, 32 aa, Artificial; identical to SEQ ID NO: 1663
  Framework sequence

SEQ ID NO: 1672 - protein, 32 aa, Artificial
  Framework sequence
RFTISRDNAKNTVYLQMNSLKPEDTAVYYCAT

SEQ ID NO: 1673 - protein, 32 aa, Artificial
  Framework sequence
RFTISWDNAKNTVYLQMNSLKPEDTAVYYCAA

SEQ ID NO: 1674 - protein, 32 aa, Artificial
  Framework sequence
RFTISRDNAKNTVYLQMNSLKPEDTAVYYCAV

SEQ ID NO: 1675 - protein, 32 aa, Artificial; identical to SEQ ID NO: 1674
  Framework sequence

SEQ ID NO: 1676 - protein, 32 aa, Artificial; identical to SEQ ID NO: 1673
  Framework sequence

SEQ ID NO: 1677 - protein, 32 aa, Artificial
  Framework sequence
RFTISWDNAKNTLYLQMNSLKPEDTAVYYCAA

SEQ ID NO: 1678 - protein, 32 aa, Artificial; identical to SEQ ID NO: 1672
  Framework sequence

SEQ ID NO: 1679 - protein, 32 aa, Artificial
  Framework sequence
RFTISWDSAKNTVYLQMNDLKPEDTAVYYCAA

SEQ ID NO: 1680 - protein, 32 aa, Artificial
  Framework sequence
RFTISRDNAKNTVYLQMNSLQPEDTAVYYCAA

SEQ ID NO: 1681 - protein, 32 aa, Artificial; identical to SEQ ID NO: 112
  Framework sequence

SEQ ID NO: 1682 - protein, 32 aa, Artificial
  Framework sequence
RFTISRDNAKNTVYLQMNSLTPEDTAVYYCAV

SEQ ID NO: 1683 - protein, 32 aa, Artificial
  Framework sequence
RFTISRDNAKNTVYLQMNGLKPEDTAVYYCAT

SEQ ID NO: 1684 - protein, 32 aa, Artificial; identical to SEQ ID NO: 1673
  Framework sequence

SEQ ID NO: 1685 - protein, 32 aa, Artificial; identical to SEQ ID NO: 1673
  Framework sequence

SEQ ID NO: 1686 - protein, 32 aa, Artificial
  Framework sequence
RFTISRDNAKNTVYLQMNSLTPEDTAVYYCAA

SEQ ID NO: 1687 - protein, 32 aa, Artificial; identical to SEQ ID NO: 1672
  Framework sequence

SEQ ID NO: 1688 - protein, 32 aa, Artificial
  Framework sequence
RFTISRDNAKNTVYLQMNSLEPEDTAVYYCAT

SEQ ID NO: 1689 - protein, 32 aa, Artificial
  Framework sequence
RFTISWDNAKNMVYLQMNSLKPEDTAVYYCAA

SEQ ID NO: 1690 - protein, 32 aa, Artificial; identical to SEQ ID NO: 1673
  Framework sequence

SEQ ID NO: 1691 - protein, 32 aa, Artificial
  Framework sequence
RFTISWDNAKKMVYLQMNKLKPEDTAVYYCAA

SEQ ID NO: 1692 - protein, 32 aa, Artificial; identical to SEQ ID NO: 1677
  Framework sequence

SEQ ID NO: 1693 - protein, 32 aa, Artificial
  Framework sequence
RFTISRDNTKNTVYLQMNSLTPEDTAIYYCAV

SEQ ID NO: 1694 - protein, 32 aa, Artificial
  Framework sequence
RFTISWDNAKNTVYLQMSSLKPEDTAVYHCAA

SEQ ID NO: 1695 - protein, 32 aa, Artificial
  Framework sequence
RFTISRDNAKNMVYLQMNSLKPEDTAVYYCAT

SEQ ID NO: 1696 - protein, 32 aa, Artificial
  Framework sequence
RFTISWDNAKNTLYLQMNSLKPGDTAVYYCAA

SEQ ID NO: 1697 - protein, 32 aa, Artificial
  Framework sequence
RFTISRDNAKNTVYLQMNNLTPEDTAVYYCAT

SEQ ID NO: 1698 - protein, 32 aa, Artificial
  Framework sequence
RFTISRDNARNTVYLQMNNLTPEDTAVYYCAT

SEQ ID NO: 1699 - protein, 32 aa, Artificial
  Framework sequence
RFTISWDNAKNIVYLQMNSLKPEDTAVYYCAA

SEQ ID NO: 1700 - protein, 32 aa, Artificial; identical to SEQ ID NO: 1679
  Framework sequence

SEQ ID NO: 1701 - protein, 32 aa, Artificial
  Framework sequence
RFTISWDNAKKVVYLQMNSLKPEDTAVYYCAA

SEQ ID NO: 1702 - protein, 32 aa, Artificial; identical to SEQ ID NO: 1689
  Framework sequence

SEQ ID NO: 1703 - protein, 32 aa, Artificial; identical to SEQ ID NO: 1683
  Framework sequence

SEQ ID NO: 1704 - protein, 32 aa, Artificial; identical to SEQ ID NO: 1677
  Framework sequence

SEQ ID NO: 1705 - protein, 31 aa, Artificial
  Framework sequence
FTISWDNAKNMVYLQMNSLKPEDTAVYYCAA

SEQ ID NO: 1706 - protein, 32 aa, Artificial; identical to SEQ ID NO: 1673
  Framework sequence

SEQ ID NO: 1707 - protein, 32 aa, Artificial
  Framework sequence
RFTISRDNTKNTVYLQMNSLTPEDTAVYYCAV

SEQ ID NO: 1708 - protein, 32 aa, Artificial; identical to SEQ ID NO: 1677
  Framework sequence

SEQ ID NO: 1709 - protein, 32 aa, Artificial; identical to SEQ ID NO: 1677
  Framework sequence

SEQ ID NO: 1710 - protein, 32 aa, Artificial; identical to SEQ ID NO: 1677
  Framework sequence

SEQ ID NO: 1711 - protein, 32 aa, Artificial; identical to SEQ ID NO: 1677
  Framework sequence

SEQ ID NO: 1712 - protein, 32 aa, Artificial
  Framework sequence
RFTISWDNAKNTLYLQMTSLKPEDTAVYYCAA

SEQ ID NO: 1713 - protein, 32 aa, Artificial
  Framework sequence
RFTISRDNAKNMVYLQMTSLKPEDTAVYYCAA

SEQ ID NO: 1714 - protein, 32 aa, Artificial; identical to SEQ ID NO: 1713
  Framework sequence

SEQ ID NO: 1715 - protein, 32 aa, Artificial
  Framework sequence
RFTISRDTAKNMVYLQMTSLKPEDTAVYYCAA

SEQ ID NO: 1716 - protein, 32 aa, Artificial; identical to SEQ ID NO: 1713
  Framework sequence

SEQ ID NO: 1717 - protein, 32 aa, Artificial
  Framework sequence
RFTISTDNAKNMVYLQMTSLKPEDTAVYYCAA

SEQ ID NO: 1718 - protein, 32 aa, Artificial; identical to SEQ ID NO: 1713
  Framework sequence

SEQ ID NO: 1719 - protein, 32 aa, Artificial; identical to SEQ ID NO: 1715
  Framework sequence

SEQ ID NO: 1720 - protein, 32 aa, Artificial
  Framework sequence
RFTISRDNAKNMVYLQMTSLMPEDTAVYYCAA

SEQ ID NO: 1721 - protein, 32 aa, Artificial; identical to SEQ ID NO: 1713
  Framework sequence

SEQ ID NO: 1722 - protein, 32 aa, Artificial
  Framework sequence
RFTISRDNAKNMVYLQMTSLKPEDTAIYYCAA

SEQ ID NO: 1723 - protein, 32 aa, Artificial; identical to SEQ ID NO: 1713
  Framework sequence

SEQ ID NO: 1724 - protein, 32 aa, Artificial; identical to SEQ ID NO: 1713
  Framework sequence

SEQ ID NO: 1725 - protein, 32 aa, Artificial; identical to SEQ ID NO: 1713
  Framework sequence

SEQ ID NO: 1726 - protein, 32 aa, Artificial
  Framework sequence
RFTISSDNAKNTVYLTMNNLKPEDTAVYYCAA

SEQ ID NO: 1727 - protein, 32 aa, Artificial
  Framework sequence
RFTISSDNAKNTVYLTMNSLKPEDTAVYYCAA

SEQ ID NO: 1728 - protein, 32 aa, Artificial
  Framework sequence
RFTISSDNAKNMVYLQMNSLKPEDTAVYYCAA

SEQ ID NO: 1729 - protein, 32 aa, Artificial; identical to SEQ ID NO: 1727
  Framework sequence

SEQ ID NO: 1730 - protein, 32 aa, Artificial; identical to SEQ ID NO: 1595
  Framework sequence

SEQ ID NO: 1731 - protein, 32 aa, Artificial; identical to SEQ ID NO: 1727
  Framework sequence

SEQ ID NO: 1732 - protein, 32 aa, Artificial; identical to SEQ ID NO: 112
  Framework sequence

SEQ ID NO: 1733 - protein, 32 aa, Artificial
  Framework sequence
RFTISSDNAKNTVYLAMNNLKPGDTAVYYCAA

SEQ ID NO: 1734 - protein, 32 aa, Artificial; identical to SEQ ID NO: 1595
  Framework sequence

SEQ ID NO: 1735 - protein, 32 aa, Artificial; identical to SEQ ID NO: 1726
  Framework sequence

SEQ ID NO: 1736 - protein, 32 aa, Artificial; identical to SEQ ID NO: 1595
  Framework sequence

SEQ ID NO: 1737 - protein, 32 aa, Artificial
  Framework sequence
RFTISKDNAKNTVYLQMNSLKPEDTAVYYCAA

SEQ ID NO: 1738 - protein, 32 aa, Artificial
  Framework sequence
RITIFRDNAKNTAYLQMNSLNPEDTAVYYCAA

SEQ ID NO: 1739 - protein, 32 aa, Artificial
  Framework sequence
RITIFRDNAKNTVYLQMNSLNPEDTAVYYCAA

SEQ ID NO: 1740 - protein, 32 aa, Artificial; identical to SEQ ID NO: 1739
  Framework sequence

SEQ ID NO: 1741 - protein, 32 aa, Artificial; identical to SEQ ID NO: 1738
  Framework sequence

SEQ ID NO: 1742 - protein, 32 aa, Artificial; identical to SEQ ID NO: 1739
  Framework sequence

SEQ ID NO: 1743 - protein, 32 aa, Artificial
  Framework sequence
RFTISRDNAKNTVYLQMNSLKPEDTAAYYCAT

SEQ ID NO: 1744 - protein, 32 aa, Artificial
  Framework sequence
RFTISRDNAKNTVYLQMNSLRPEDTAVYYCAA

SEQ ID NO: 1745 - protein, 32 aa, Artificial; identical to SEQ ID NO: 1744
  Framework sequence

SEQ ID NO: 1746 - protein, 32 aa, Artificial; identical to SEQ ID NO: 1744
  Framework sequence

SEQ ID NO: 1747 - protein, 32 aa, Artificial; identical to SEQ ID NO: 1744
  Framework sequence

SEQ ID NO: 1748 - protein, 32 aa, Artificial; identical to SEQ ID NO: 1605
  Framework sequence

SEQ ID NO: 1749 - protein, 32 aa, Artificial
  Framework sequence
RFTISRDNAKNTVYLQMNSLKPEDTAVYYCYL

SEQ ID NO: 1750 - protein, 31 aa, Artificial
  Framework sequence
FTMSRDNAKSSVYLQMINLKPEDTAVYYCAA

SEQ ID NO: 1751 - protein, 30 aa, Artificial
  Framework sequence
SISRDNAKSAVYLQMNNLKPEDTAVYYCAA

SEQ ID NO: 1752 - protein, 31 aa, Artificial; identical to SEQ ID NO: 1750
  Framework sequence

SEQ ID NO: 1753 - protein, 31 aa, Artificial; identical to SEQ ID NO: 1750
  Framework sequence

SEQ ID NO: 1754 - protein, 30 aa, Artificial; identical to SEQ ID NO: 1751
  Framework sequence

SEQ ID NO: 1755 - protein, 31 aa, Artificial
  Framework sequence
FTMSRDNAKSSVYLQMINLEPEDTAVYYCAA

SEQ ID NO: 1756 - protein, 32 aa, Artificial
  Framework sequence
RITISRDNAKNTVYLQMNSLKPEDTAIYYCAA

SEQ ID NO: 1757 - protein, 32 aa, Artificial
  Framework sequence
RITISRDNAKNTVYLQMNSLTPEDTAIYYCAA

SEQ ID NO: 1758 - protein, 32 aa, Artificial; identical to SEQ ID NO: 1756
  Framework sequence

SEQ ID NO: 1759 - protein, 32 aa, Artificial; identical to SEQ ID NO: 1672
  Framework sequence

SEQ ID NO: 1760 - protein, 32 aa, Artificial; identical to SEQ ID NO: 1672
  Framework sequence

SEQ ID NO: 1761 - protein, 32 aa, Artificial
  Framework sequence
RFTMSRDNAKNTLYLQMNSLEPEDTAVYSCAA

SEQ ID NO: 1762 - protein, 32 aa, Artificial
  Framework sequence
RFTISRDNAKNTVYLQMNSLKPDDTAVYYCAT

SEQ ID NO: 1763 - protein, 32 aa, Artificial; identical to SEQ ID NO: 112
  Framework sequence

SEQ ID NO: 1764 - protein, 32 aa, Artificial; identical to SEQ ID NO: 112
  Framework sequence

SEQ ID NO: 1765 - protein, 32 aa, Artificial
  Framework sequence
RFTISRDNAKNTVYLQMSSLKPEDTAVYYCAA

SEQ ID NO: 1766 - protein, 32 aa, Artificial; identical to SEQ ID NO: 112
  Framework sequence

SEQ ID NO: 1767 - protein, 32 aa, Artificial; identical to SEQ ID NO: 112
  Framework sequence

SEQ ID NO: 1768 - protein, 32 aa, Artificial
  Framework sequence
RFIISRDNAKNTVYLLMNSLQSDDTAVYYCVA

SEQ ID NO: 1769 - protein, 32 aa, Artificial
  Framework sequence
RFIISRDNAKNTVHLLMNSLQSDDTAVYYCVA

SEQ ID NO: 1770 - protein, 32 aa, Artificial
  Framework sequence
RLTVSRDNAKNTAYLQMNSLKPEDTAVYYCAA

SEQ ID NO: 1771 - protein, 32 aa, Artificial
  Framework sequence
RFTISRDNAKNTVYLQMNSLESEDTAVYYCAA

SEQ ID NO: 1772 - protein, 32 aa, Artificial
  Framework sequence
RFTISRDNAKNTLYLQMNSLKPEDTGVYYCAK

SEQ ID NO: 1773 - protein, 32 aa, Artificial
  Framework sequence
RFTISRDNAKNTGYLQMNSLKPEDTAVYYCAL

SEQ ID NO: 1774 - protein, 32 aa, Artificial
  Framework sequence
RFTMFSDNAKNTVALQMNSLKPEDTAVYYCTV

SEQ ID NO: 1775 - protein, 32 aa, Artificial
  Framework sequence
RFTISRDNAKNTVHLQMNSLKPEDTAVYYCAA

SEQ ID NO: 1776 - protein, 32 aa, Artificial; identical to SEQ ID NO: 1595
  Framework sequence

SEQ ID NO: 1777 - protein, 32 aa, Artificial
  Framework sequence
RFTISRDNAKNTLYLQMNSLKPEDTAVYYCAK

SEQ ID NO: 1778 - protein, 32 aa, Artificial; identical to SEQ ID NO: 1595
  Framework sequence

SEQ ID NO: 1779 - protein, 32 aa, Artificial
  Framework sequence
RFTVSRDNAQNTVYLQMNSLKPDDTAVYYCYV

SEQ ID NO: 1780 - protein, 32 aa, Artificial
  Framework sequence
RFTLSRDNAKNTVYLQMNSLKPEDTAVYYCAA

SEQ ID NO: 1781 - protein, 32 aa, Artificial
  Framework sequence
RFTISRDNAKNTGYLQMNSLVPDDTAVYYCGA

SEQ ID NO: 1782 - protein, 32 aa, Artificial
  Framework sequence
RFTISKDNAKNTGYLQMNSLAPDDTAVYYCGA

SEQ ID NO: 1783 - protein, 32 aa, Artificial; identical to SEQ ID NO: 112
  Framework sequence

SEQ ID NO: 1784 - protein, 32 aa, Artificial
  Framework sequence
RFTISRDNAKNAVYLQMNSLKPEDSAVYYCAF

SEQ ID NO: 1785 - protein, 32 aa, Artificial
  Framework sequence
RFTVSRDNAKNMVYLQMNSLKPEDTAVYYCAA

SEQ ID NO: 1786 - protein, 32 aa, Artificial
  Framework sequence
RFTISRDNAKETVSLQMSGLKPEDTAVYYCAA

SEQ ID NO: 1787 - protein, 32 aa, Artificial
  Framework sequence
RFTISRDNAKEIVSLQMSGLKPEDTAVYYCAA

SEQ ID NO: 1788 - protein, 32 aa, Artificial; identical to SEQ ID NO: 1786
  Framework sequence

SEQ ID NO: 1789 - protein, 32 aa, Artificial
  Framework sequence
RFTISRDNAKETVSLQMNGLKPEDTAVYYCAA

SEQ ID NO: 1790 - protein, 32 aa, Artificial
  Framework sequence
RFIISRDDAANTAYLQMNSLKPEDTAVYYCAV

SEQ ID NO: 1791 - protein, 32 aa, Artificial; identical to SEQ ID NO: 1643
  Framework sequence

SEQ ID NO: 1792 - protein, 32 aa, Artificial
  Framework sequence
RFTISEDNANNTVYLQMHSVKPEDTATYYCAA

SEQ ID NO: 1793 - protein, 32 aa, Artificial
  Framework sequence
RFAISRDNAKSTVYLQMNSLKPEDTAVYYCAI

SEQ ID NO: 1794 - protein, 32 aa, Artificial; identical to SEQ ID NO: 1595
  Framework sequence

SEQ ID NO: 1795 - protein, 32 aa, Artificial
  Framework sequence
RFTMSSDNAKNTVDLQMNSLKPEDTALYYCAG

SEQ ID NO: 1796 - protein, 32 aa, Artificial
  Framework sequence
RFTISRDDAQNAVYLQMNSLKPEDTAVYYCAA

SEQ ID NO: 1797 - protein, 32 aa, Artificial
  Framework sequence
RFTISRDNAKNTLYLQMSSLKPEDTALYYCAR

SEQ ID NO: 1798 - protein, 32 aa, Artificial
  Framework sequence
RFTISRDNAKNTVYLQMNSLKPEDTADYLCAA

SEQ ID NO: 1799 - protein, 32 aa, Artificial
  Framework sequence
RFTISRDNANNAVYLQMNSLQPEDTAIYYCAA

SEQ ID NO: 1800 - protein, 32 aa, Artificial; identical to SEQ ID NO: 1616
  Framework sequence

SEQ ID NO: 1801 - protein, 32 aa, Artificial
  Framework sequence
RFTISRDNAKNTVYLQMNSLKPEDTAVYYCNV

SEQ ID NO: 1802 - protein, 32 aa, Artificial
  Framework sequence
RFTISRDNAKNTMYLQMNSLKPEDTAVYYCAA

SEQ ID NO: 1803 - protein, 32 aa, Artificial
  Framework sequence
RFTISRDNAKNTVYLQMNSLKPEDTAVYICNA

SEQ ID NO: 1804 - protein, 32 aa, Artificial
  Framework sequence
RFTSSRDNAKNTAYLQMNSLGPEDTAVYYCNF

SEQ ID NO: 1805 - protein, 32 aa, Artificial
  Framework sequence
RFTIARDNAKNTVYLQANNMKPEDTAVYYCAA

SEQ ID NO: 1806 - protein, 32 aa, Artificial; identical to SEQ ID NO: 1805
  Framework sequence

SEQ ID NO: 1807 - protein, 32 aa, Artificial
  Framework sequence
RFTITRDNAKNTVYLQANNMKPEDTAVYYCAA

SEQ ID NO: 1808 - protein, 32 aa, Artificial
  Framework sequence
RFTIARDNAKNTVYLQADNMKPEDTAVYYCAA

SEQ ID NO: 1809 - protein, 32 aa, Artificial; identical to SEQ ID NO: 1805
  Framework sequence

SEQ ID NO: 1810 - protein, 32 aa, Artificial
  Framework sequence
RFTISRDNAKNTLYLQMNSLKAEDTAVYYCAK

SEQ ID NO: 1811 - protein, 32 aa, Artificial; identical to SEQ ID NO: 1569
  Framework sequence

SEQ ID NO: 1812 - protein, 32 aa, Artificial
  Framework sequence
RFTISRDNAENTVHLQMNSLKPEDTAVYTCAA

SEQ ID NO: 1813 - protein, 32 aa, Artificial
  Framework sequence
RFTISRDNAENLVYLQMNSLKPEDTAVYTCVA

SEQ ID NO: 1814 - protein, 32 aa, Artificial
  Framework sequence
RFTMSRDNAKNTVYLEMNNLKPEDTAVYYCAA

SEQ ID NO: 1815 - protein, 32 aa, Artificial
  Framework sequence
RFTISRDNAKNTVYLQMNSLKPEDTAVYNCAA

SEQ ID NO: 1816 - protein, 32 aa, Artificial
  Framework sequence
RFTISRDNAKNTVYLKMNSLKPEDTAVYYCAV

SEQ ID NO: 1817 - protein, 32 aa, Artificial; identical to SEQ ID NO: 1596
  Framework sequence

SEQ ID NO: 1818 - protein, 15 aa, Artificial
  CDR3 sequence
ASGGGSIRSARRYDY

SEQ ID NO: 1819 - protein, 17 aa, Artificial
  CDR3 sequence
DDQKYDYIAYAEYEYDY

SEQ ID NO: 1820 - protein, 11 aa, Artificial
  CDR3 sequence
DWASDYAGYSP

SEQ ID NO: 1821 - protein, 11 aa, Artificial
  CDR3 sequence
DWHNDPNKNEY

SEQ ID NO: 1822 - protein, 11 aa, Artificial
  CDR3 sequence
DWYNDPNKNEY

SEQ ID NO: 1823 - protein, 11 aa, Artificial
  CDR3 sequence
DWFDDPNKNEY

SEQ ID NO: 1824 - protein, 11 aa, Artificial
  CDR3 sequence
DWHSDPNKHEY

SEQ ID NO: 1825 - protein, 11 aa, Artificial
  CDR3 sequence
DWYDDPNKNEY

SEQ ID NO: 1826 - protein, 11 aa, Artificial
  CDR3 sequence
DWASDYAGYSP

SEQ ID NO: 1827 - protein, 11 aa, Artificial
  CDR3 sequence
DWHNDPNKNEY

SEQ ID NO: 1828 - protein, 11 aa, Artificial
  CDR3 sequence
DWASDYAGYSP

SEQ ID NO: 1829 - protein, 11 aa, Artificial
  CDR3 sequence
DWHSEPNKYEY

SEQ ID NO: 1830 - protein, 10 aa, Artificial
  CDR3 sequence
SLTLTDSPDL

SEQ ID NO: 1831 - protein, 11 aa, Artificial
  CDR3 sequence
DWYNDPNKNEY

SEQ ID NO: 1832 - protein, 7 aa, Artificial
  CDR3 sequence
VGNFTTY

SEQ ID NO: 1833 - protein, 11 aa, Artificial
  CDR3 sequence
DWYDDPNKNEY

SEQ ID NO: 1834 - protein, 11 aa, Artificial
  CDR3 sequence
DWYNDPNKNEY

SEQ ID NO: 1835 - protein, 11 aa, Artificial
  CDR3 sequence
DWYNDPNKNEY

SEQ ID NO: 1836 - protein, 11 aa, Artificial
  CDR3 sequence
DWASDYAGYSP

SEQ ID NO: 1837 - protein, 11 aa, Artificial
  CDR3 sequence
DWASDYAGYSP

SEQ ID NO: 1838 - protein, 18 aa, Artificial
  CDR3 sequence
DLSPGNEYGEMMEYEYDY

SEQ ID NO: 1839 - protein, 11 aa, Artificial
  CDR3 sequence
DWYNDPNKNEY

SEQ ID NO: 1840 - protein, 11 aa, Artificial
  CDR3 sequence
DWYDDPNKNEY

SEQ ID NO: 1841 - protein, 11 aa, Artificial
  CDR3 sequence
DWYNDPNKNEY

SEQ ID NO: 1842 - protein, 11 aa, Artificial
  CDR3 sequence
DWASDYAGYSP

SEQ ID NO: 1843 - protein, 11 aa, Artificial
  CDR3 sequence
DWASDYAGYSP

SEQ ID NO: 1844 - protein, 14 aa, Artificial
  CDR3 sequence
DADGWWHRGQAYHW

SEQ ID NO: 1845 - protein, 11 aa, Artificial
  CDR3 sequence
DWYNDPNKNEY

SEQ ID NO: 1846 - protein, 15 aa, Artificial
  CDR3 sequence
ECAMYGSSWPPPCMD

SEQ ID NO: 1847 - protein, 11 aa, Artificial
  CDR3 sequence
DWYDDPNKNEY

SEQ ID NO: 1848 - protein, 11 aa, Artificial
  CDR3 sequence
DWASDYAGYSP

SEQ ID NO: 1849 - protein, 11 aa, Artificial
  CDR3 sequence
DWHNDPNKNEY

SEQ ID NO: 1850 - protein, 17 aa, Artificial
  CDR3 sequence
DTQFSGYVPKETNEYDY

SEQ ID NO: 1851 - protein, 18 aa, Artificial
  CDR3 sequence
ELTNRNSGAYYYAWAYDY

SEQ ID NO: 1852 - protein, 12 aa, Artificial
  CDR3 sequence
RPRFWGSYEYDY

SEQ ID NO: 1853 - protein, 14 aa, Artificial
  CDR3 sequence
DLTSSCPIYSGTDY

SEQ ID NO: 1854 - protein, 19 aa, Artificial
  CDR3 sequence
APKSWGTWPLVADTRSYHF

SEQ ID NO: 1855 - protein, 18 aa, Artificial
  CDR3 sequence
DSTNRNSGAVYYSWAYDY

SEQ ID NO: 1856 - protein, 18 aa, Artificial
  CDR3 sequence
DSTNRNRGAIYYTWAYDY

SEQ ID NO: 1857 - protein, 21 aa, Artificial
  CDR3 sequence
DSAFGTGYSDNYYSTSEEYDY

SEQ ID NO: 1858 - protein, 18 aa, Artificial
  CDR3 sequence
SSRIYIYSDSLSERSYDY

SEQ ID NO: 1859 - protein, 18 aa, Artificial
  CDR3 sequence
DSTNRNSGAIYYTWAYDY

SEQ ID NO: 1860 - protein, 4 aa, Artificial
  CDR3 sequence
GYIY

SEQ ID NO: 1861 - protein, 18 aa, Artificial
  CDR3 sequence
DSTNRNSGAWYYTWAYDH

SEQ ID NO: 1862 - protein, 12 aa, Artificial
  CDR3 sequence
KTLVGVTTAFDR

SEQ ID NO: 1863 - protein, 17 aa, Artificial
  CDR3 sequence
DTQYSGVVLKESTDYDY

SEQ ID NO: 1864 - protein, 17 aa, Artificial
  CDR3 sequence
DTQYSGVVLKESTDYDY

SEQ ID NO: 1865 - protein, 12 aa, Artificial
  CDR3 sequence
RGVAVTTILWNY

SEQ ID NO: 1866 - protein, 12 aa, Artificial
  CDR3 sequence
RPRFWGSYEYDY

SEQ ID NO: 1867 - protein, 12 aa, Artificial
  CDR3 sequence
RPRFWGSYEYDY

SEQ ID NO: 1868 - protein, 19 aa, Artificial
  CDR3 sequence
APKSWGTWPLVADTRSYHF

SEQ ID NO: 1869 - protein, 19 aa, Artificial
  CDR3 sequence
APKSWGTWPLVADTRSYHF

SEQ ID NO: 1870 - protein, 18 aa, Artificial
  CDR3 sequence
DSTNRNSGAWYYTWAYDH

SEQ ID NO: 1871 - protein, 18 aa, Artificial
  CDR3 sequence
QGSIVFYSNWDRASQYDY

SEQ ID NO: 1872 - protein, 18 aa, Artificial
  CDR3 sequence
NRDSGSSYITFSLADFGS

SEQ ID NO: 1873 - protein, 18 aa, Artificial
  CDR3 sequence
ELTNRNSGAYYYAWAYDY

SEQ ID NO: 1874 - protein, 18 aa, Artificial
  CDR3 sequence
DSTNRNSGAVYYTWAYDY

SEQ ID NO: 1875 - protein, 18 aa, Artificial
  CDR3 sequence
DSTNRNSGAVYYTWAYDY

SEQ ID NO: 1876 - protein, 18 aa, Artificial
  CDR3 sequence
DSTNRNSGAVYYTWAWDY

SEQ ID NO: 1877 - protein, 20 aa, Artificial
  CDR3 sequence
DFSLAQYKTIHRMPPYGMDY

SEQ ID NO: 1878 - protein, 18 aa, Artificial
  CDR3 sequence
DATNRNSGAYYYTWAYDY

SEQ ID NO: 1879 - protein, 18 aa, Artificial
  CDR3 sequence
DSTNRNSGAVYYTWAYDY

SEQ ID NO: 1880 - protein, 18 aa, Artificial
  CDR3 sequence
DSTNRNSGAWYYTWAYDH

SEQ ID NO: 1881 - protein, 18 aa, Artificial
  CDR3 sequence
ELTNRNSGAYYYTWAYDY

SEQ ID NO: 1882 - protein, 18 aa, Artificial
  CDR3 sequence
DSTNRNSGAIYYTWAYDY

SEQ ID NO: 1883 - protein, 18 aa, Artificial
  CDR3 sequence
DSTNRNSGAVYYPWAYDY

SEQ ID NO: 1884 - protein, 18 aa, Artificial
  CDR3 sequence
DSTNRNSGAVYYSWAYDY

SEQ ID NO: 1885 - protein, 18 aa, Artificial
  CDR3 sequence
DSTNRNSGAIYYTWAYDY

SEQ ID NO: 1886 - protein, 18 aa, Artificial
  CDR3 sequence
DSTNRNSGAVYYSWAYDY

SEQ ID NO: 1887 - protein, 14 aa, Artificial
  CDR3 sequence
QIIPRVMPLRSNDY

SEQ ID NO: 1888 - protein, 10 aa, Artificial
  CDR3 sequence
RWYEGIWREY

SEQ ID NO: 1889 - protein, 16 aa, Artificial
  CDR3 sequence
SLGTIWYQKDYRAYDA

SEQ ID NO: 1890 - protein, 12 aa, Artificial
  CDR3 sequence
RPRFWGSYEYDY

SEQ ID NO: 1891 - protein, 16 aa, Artificial
  CDR3 sequence
NRQGEVFRTTRLDYDS

SEQ ID NO: 1892 - protein, 12 aa, Artificial
  CDR3 sequence
DRYPFVSREYDY

SEQ ID NO: 1893 - protein, 11 aa, Artificial
  CDR3 sequence
RQYESDRWRDY

SEQ ID NO: 1894 - protein, 19 aa, Artificial
  CDR3 sequence
DFSRSWGTCNEEYYYGMDY

SEQ ID NO: 1895 - protein, 12 aa, Artificial
  CDR3 sequence
KTIVGGTTAWBR

SEQ ID NO: 1896 - protein, 12 aa, Artificial
  CDR3 sequence
KTIVGGTTAWDR

SEQ ID NO: 1897 - protein, 12 aa, Artificial
  CDR3 sequence
DLYPFVSREYDY

SEQ ID NO: 1898 - protein, 14 aa, Artificial
  CDR3 sequence
DLDGNGSIDYGYEY

SEQ ID NO: 1899 - protein, 12 aa, Artificial
  CDR3 sequence
DRYPFISKEYDY

SEQ ID NO: 1900 - protein, 11 aa, Artificial
  CDR3 sequence
RQHDGGSWYDY

SEQ ID NO: 1901 - protein, 15 aa, Artificial
  CDR3 sequence
LGRMAVAHSVSDFNS

SEQ ID NO: 1902 - protein, 18 aa, Artificial
  CDR3 sequence
SSRIYIYSDSLSERSYDY

SEQ ID NO: 1903 - protein, 18 aa, Artificial
  CDR3 sequence
ELTNRNPGAYYYTWAYDY

SEQ ID NO: 1904 - protein, 18 aa, Artificial
  CDR3 sequence
SSRIYIYSDSLSEGSYDY

SEQ ID NO: 1905 - protein, 18 aa, Artificial
  CDR3 sequence
SSRIYIYSDSLSERSYDY

SEQ ID NO: 1906 - protein, 11 aa, Artificial
  CDR3 sequence
RGLGSHRVSDY

SEQ ID NO: 1907 - protein, 11 aa, Artificial
  CDR3 sequence
RGLGSHRVSDY

SEQ ID NO: 1908 - protein, 17 aa, Artificial
  CDR3 sequence
NPSYVYSDYLSLAGYTY

SEQ ID NO: 1909 - protein, 10 aa, Artificial
  CDR3 sequence
PWMDYNRRDY

SEQ ID NO: 1910 - protein, 15 aa, Artificial
  CDR3 sequence
LGRMAVAHSVSDFNS

SEQ ID NO: 1911 - protein, 11 aa, Artificial
  CDR3 sequence
RTLGAHGIDDY

SEQ ID NO: 1912 - protein, 18 aa, Artificial
  CDR3 sequence
SSRIYIYSDSLSERSYDY

SEQ ID NO: 1913 - protein, 18 aa, Artificial
  CDR3 sequence
DSTNRNSGAWYYTWAYDH

SEQ ID NO: 1914 - protein, 11 aa, Artificial
  CDR3 sequence
KQPENHAITNY

SEQ ID NO: 1915 - protein, 11 aa, Artificial
  CDR3 sequence
RGAGAHRVDDY

SEQ ID NO: 1916 - protein, 18 aa, Artificial
  CDR3 sequence
ELTNRNSGAYYYAWAYDY

SEQ ID NO: 1917 - protein, 15 aa, Artificial
  CDR3 sequence
EGREARNHGLYEYHS

SEQ ID NO: 1918 - protein, 11 aa, Artificial
  CDR3 sequence
RVPGAHYIMDY

SEQ ID NO: 1919 - protein, 11 aa, Artificial
  CDR3 sequence
KQPENHAITNY

SEQ ID NO: 1920 - protein, 3 aa, Artificial
  CDR3 sequence
LDN

SEQ ID NO: 1921 - protein, 17 aa, Artificial
  CDR3 sequence
DTQFSGYVPKETNEYDY

SEQ ID NO: 1922 - protein, 17 aa, Artificial
  CDR3 sequence
DTQFSGYVPKETNEYDY

SEQ ID NO: 1923 - protein, 15 aa, Artificial
  CDR3 sequence
RAGSGLRTTINDYTY

SEQ ID NO: 1924 - protein, 12 aa, Artificial
  CDR3 sequence
KTLVGDTTAFDR

SEQ ID NO: 1925 - protein, 17 aa, Artificial
  CDR3 sequence
KENGMFITATQEQSYDY

SEQ ID NO: 1926 - protein, 12 aa, Artificial
  CDR3 sequence
DLYPFVSREYDY

SEQ ID NO: 1927 - protein, 12 aa, Artificial
  CDR3 sequence
RPRFWGSYEYDY

SEQ ID NO: 1928 - protein, 17 aa, Artificial
  CDR3 sequence
DTEFSGYVQKESNDYDY

SEQ ID NO: 1929 - protein, 7 aa, Artificial
  CDR3 sequence
VSYGEYF

SEQ ID NO: 1930 - protein, 10 aa, Artificial
  CDR3 sequence
GLMAEVTAGY

SEQ ID NO: 1931 - protein, 7 aa, Artificial
  CDR3 sequence
VSYGEYF

SEQ ID NO: 1932 - protein, 13 aa, Artificial
  CDR3 sequence
DSSVVPGIEKYDD

SEQ ID NO: 1933 - protein, 15 aa, Artificial
  CDR3 sequence
ALIGGYYSDVDAWSY

SEQ ID NO: 1934 - protein, 16 aa, Artificial
  CDR3 sequence
ATYGYGSYTYGGSYDL

SEQ ID NO: 1935 - protein, 9 aa, Artificial
  CDR3 sequence
NLYPTTDDV

SEQ ID NO: 1936 - protein, 17 aa, Artificial
  CDR3 sequence
DKGVYTTVSRSMADYGA

SEQ ID NO: 1937 - protein, 16 aa, Artificial
  CDR3 sequence
ATYGYGSYTYGGSYDL

SEQ ID NO: 1938 - protein, 9 aa, Artificial
  CDR3 sequence
EVIYYPYDY

SEQ ID NO: 1939 - protein, 16 aa, Artificial
  CDR3 sequence
ATYGYGSYTYGGSYDL

SEQ ID NO: 1940 - protein, 16 aa, Artificial
  CDR3 sequence
RQDYGLGYRDLHEYDY

SEQ ID NO: 1941 - protein, 16 aa, Artificial
  CDR3 sequence
RQDYGLGYRESHEYDY

SEQ ID NO: 1942 - protein, 16 aa, Artificial
  CDR3 sequence
RQDYGLGYRESHEYDY

SEQ ID NO: 1943 - protein, 16 aa, Artificial
  CDR3 sequence
RQDYGLGYRESHEYDY

SEQ ID NO: 1944 - protein, 15 aa, Artificial
  CDR3 sequence
SKEWDISASGDDYDY

SEQ ID NO: 1945 - protein, 6 aa, Artificial
  CDR3 sequence
DGIYSS

SEQ ID NO: 1946 - protein, 6 aa, Artificial
  CDR3 sequence
DGIYSS

SEQ ID NO: 1947 - protein, 6 aa, Artificial
  CDR3 sequence
DGIHSS

SEQ ID NO: 1948 - protein, 6 aa, Artificial
  CDR3 sequence
DGIYSS

SEQ ID NO: 1949 - protein, 6 aa, Artificial
  CDR3 sequence
DGIYSS

SEQ ID NO: 1950 - protein, 6 aa, Artificial
  CDR3 sequence
DGIYSS

SEQ ID NO: 1951 - protein, 6 aa, Artificial
  CDR3 sequence
DGIYSS

SEQ ID NO: 1952 - protein, 6 aa, Artificial
  CDR3 sequence
DGIYSS

SEQ ID NO: 1953 - protein, 6 aa, Artificial
  CDR3 sequence
DGIHSS

SEQ ID NO: 1954 - protein, 17 aa, Artificial
  CDR3 sequence
DPALGCYSGTYYPRYDY

SEQ ID NO: 1955 - protein, 17 aa, Artificial
  CDR3 sequence
DPALGCYSGSYYPRYDY

SEQ ID NO: 1956 - protein, 17 aa, Artificial
  CDR3 sequence
DPALGCYSGSYYPRYDY

SEQ ID NO: 1957 - protein, 17 aa, Artificial
  CDR3 sequence
DPALGCYSGSYYPRYDY

SEQ ID NO: 1958 - protein, 17 aa, Artificial
  CDR3 sequence
DPALGCYSGSYYPRYDY

SEQ ID NO: 1959 - protein, 17 aa, Artificial
  CDR3 sequence
DPALGCYSGSYYPRYDY

SEQ ID NO: 1960 - protein, 17 aa, Artificial
  CDR3 sequence
DPALGCYSGSYYPRYDY

SEQ ID NO: 1961 - protein, 17 aa, Artificial
  CDR3 sequence
DPALGCYSGSYYPRYDY

SEQ ID NO: 1962 - protein, 17 aa, Artificial
  CDR3 sequence
DPALGCYSGSYYPRYDY

SEQ ID NO: 1963 - protein, 17 aa, Artificial
  CDR3 sequence
DPALGCYSGSYYPRYDY

SEQ ID NO: 1964 - protein, 17 aa, Artificial
  CDR3 sequence
DPALGCYSGSYYPRYDY

SEQ ID NO: 1965 - protein, 17 aa, Artificial
  CDR3 sequence
DPALGCYSGSYYPRYDY

SEQ ID NO: 1966 - protein, 17 aa, Artificial
  CDR3 sequence
DPALGCYSGNYYPRYDY

SEQ ID NO: 1967 - protein, 17 aa, Artificial
  CDR3 sequence
DPALGCYSGSYYPRYDY

SEQ ID NO: 1968 - protein, 17 aa, Artificial
  CDR3 sequence
DPALGCYSGNYYPRYDY

SEQ ID NO: 1969 - protein, 17 aa, Artificial
  CDR3 sequence
DPALGCYSGSYYPRYDY

SEQ ID NO: 1970 - protein, 17 aa, Artificial
  CDR3 sequence
DPALGCYSGSYYPRYDY

SEQ ID NO: 1971 - protein, 17 aa, Artificial
  CDR3 sequence
DPALGCYSGNYYPRYDY

SEQ ID NO: 1972 - protein, 17 aa, Artificial
  CDR3 sequence
DPALGCYSGSYYPRYDY

SEQ ID NO: 1973 - protein, 17 aa, Artificial
  CDR3 sequence
DPALGCYSGSYYPRYDY

SEQ ID NO: 1974 - protein, 17 aa, Artificial
  CDR3 sequence
DPALGCYSGSYYPRYDF

SEQ ID NO: 1975 - protein, 17 aa, Artificial
  CDR3 sequence
DPALGCYSGNYYPRYDY

SEQ ID NO: 1976 - protein, 17 aa, Artificial
  CDR3 sequence
DPALGCYSGSYYPRYDY

SEQ ID NO: 1977 - protein, 17 aa, Artificial
  CDR3 sequence
DPALGCYSGSYYPRYDY

SEQ ID NO: 1978 - protein, 17 aa, Artificial
  CDR3 sequence
DPALGCYSGSYYPRYDY

SEQ ID NO: 1979 - protein, 17 aa, Artificial
  CDR3 sequence
DPALGCYSGNYYPRYDY

SEQ ID NO: 1980 - protein, 17 aa, Artificial
  CDR3 sequence
DPALGCYSGNYYPRYDY

SEQ ID NO: 1981 - protein, 17 aa, Artificial
  CDR3 sequence
DPALGCYSGSYYPRYDY

SEQ ID NO: 1982 - protein, 17 aa, Artificial
  CDR3 sequence
DPALGCYSGSYYPRYDY

SEQ ID NO: 1983 - protein, 17 aa, Artificial
  CDR3 sequence
DPALGCYSGSYYPRYDY

SEQ ID NO: 1984 - protein, 17 aa, Artificial
  CDR3 sequence
DPALGCYSGSYYPRYDY

SEQ ID NO: 1985 - protein, 17 aa, Artificial
  CDR3 sequence
DPALGCYSGSYYPRYDY

SEQ ID NO: 1986 - protein, 17 aa, Artificial
  CDR3 sequence
DPALGCYSGSYYPRYDY

SEQ ID NO: 1987 - protein, 17 aa, Artificial
  CDR3 sequence
DPALGCYSGSYYPRYDY

SEQ ID NO: 1988 - protein, 17 aa, Artificial
  CDR3 sequence
DPALGCYSGSYYPRYDY

SEQ ID NO: 1989 - protein, 17 aa, Artificial
  CDR3 sequence
DPALGCYSGNYYPRYDY

SEQ ID NO: 1990 - protein, 17 aa, Artificial
  CDR3 sequence
DPALGCYSGSYYPRYDF

SEQ ID NO: 1991 - protein, 17 aa, Artificial
  CDR3 sequence
DPALGCYSGNYYPRYDF

SEQ ID NO: 1992 - protein, 17 aa, Artificial
  CDR3 sequence
DPALGCYSGNYYPRYDF

SEQ ID NO: 1993 - protein, 17 aa, Artificial
  CDR3 sequence
DPALGCYSGSYYPRYDF

SEQ ID NO: 1994 - protein, 17 aa, Artificial
  CDR3 sequence
DPALGCYSGSYYPRYDF

SEQ ID NO: 1995 - protein, 17 aa, Artificial
  CDR3 sequence
DFALGCYSGSYVPRYDY

SEQ ID NO: 1996 - protein, 17 aa, Artificial
  CDR3 sequence
DFALGCYSGSYYPRYDY

SEQ ID NO: 1997 - protein, 17 aa, Artificial
  CDR3 sequence
DFALGCYSGSYYPRYDY

SEQ ID NO: 1998 - protein, 17 aa, Artificial
  CDR3 sequence
DFALGCYSGSYYPRYDY

SEQ ID NO: 1999 - protein, 17 aa, Artificial
  CDR3 sequence
DFALGCYSGSYYPRYDY

SEQ ID NO: 2000 - protein, 17 aa, Artificial
  CDR3 sequence
DFALGCYSGSYYPRYDY

SEQ ID NO: 2001 - protein, 17 aa, Artificial
  CDR3 sequence
DFALGCYSGSYYPRYDY

SEQ ID NO: 2002 - protein, 17 aa, Artificial
  CDR3 sequence
DFALGCYSGSYYPRYDY

SEQ ID NO: 2003 - protein, 17 aa, Artificial
  CDR3 sequence
DFALGCYSGSYYPRYDY

SEQ ID NO: 2004 - protein, 17 aa, Artificial
  CDR3 sequence
DFALGCYSGSYYPRYDY

SEQ ID NO: 2005 - protein, 17 aa, Artificial
  CDR3 sequence
DFALGCYSGSYYPRYDY

SEQ ID NO: 2006 - protein, 17 aa, Artificial
  CDR3 sequence
DFALGCYSGSYVPRYDY

SEQ ID NO: 2007 - protein, 17 aa, Artificial
  CDR3 sequence
DFPLGCYSGSYVPRYDY

SEQ ID NO: 2008 - protein, 24 aa, Artificial
  CDR3 sequence
DRLSTVVGCLYYGGSYYPRTTIDY

SEQ ID NO: 2009 - protein, 24 aa, Artificial
  CDR3 sequence
DLLSTVVGCLYYRGSYYPRTTADY

SEQ ID NO: 2010 - protein, 24 aa, Artificial
  CDR3 sequence
DLLRTAVGCLDYRGTYYPRTTMDY

SEQ ID NO: 2011 - protein, 24 aa, Artificial
  CDR3 sequence
DLLSTVVGCLYYRGSYYPRTTADY

SEQ ID NO: 2012 - protein, 24 aa, Artificial
  CDR3 sequence
DLLRTAVGCLYYRGTYYPRTTMDY

SEQ ID NO: 2013 - protein, 24 aa, Artificial
  CDR3 sequence
DQLSTVVGCFYYRGSYYPRTTADY

SEQ ID NO: 2014 - protein, 24 aa, Artificial
  CDR3 sequence
DLLATAVGCLYYRGTYYPRTTMDY

SEQ ID NO: 2015 - protein, 24 aa, Artificial
  CDR3 sequence
DLLSTVVGCLYYGGSYYPRTTIDY

SEQ ID NO: 2016 - protein, 24 aa, Artificial
  CDR3 sequence
DLLRTVVGCLYYGGRYSPRTTTDY

SEQ ID NO: 2017 - protein, 24 aa, Artificial
  CDR3 sequence
DLLSTVVGCLYYGGSYYPRTTIDY

SEQ ID NO: 2018 - protein, 24 aa, Artificial
  CDR3 sequence
DLLRTAVGCLHYRGSYYPRTTIDY

SEQ ID NO: 2019 - protein, 24 aa, Artificial
  CDR3 sequence
DLLRTVVGCLYYGGSYSPRTTMDY

SEQ ID NO: 2020 - protein, 13 aa, Artificial
  CDR3 sequence
APTLVEITTTPTY

SEQ ID NO: 2021 - protein, 13 aa, Artificial
  CDR3 sequence
APTLVEITPTPTY

SEQ ID NO: 2022 - protein, 13 aa, Artificial
  CDR3 sequence
APTLVEITPTPTY

SEQ ID NO: 2023 - protein, 13 aa, Artificial
  CDR3 sequence
APTLVEITTTPTY

SEQ ID NO: 2024 - protein, 13 aa, Artificial
  CDR3 sequence
APTLVEITPTPTY

SEQ ID NO: 2025 - protein, 14 aa, Artificial
  CDR3 sequence
TDDYINTTPALYRN

SEQ ID NO: 2026 - protein, 14 aa, Artificial
  CDR3 sequence
DSNVNTVKLGWGRY

SEQ ID NO: 2027 - protein, 14 aa, Artificial
  CDR3 sequence
DSSVNTVKLGWGRY

SEQ ID NO: 2028 - protein, 14 aa, Artificial
  CDR3 sequence
DSNVNTVKLGWGRY

SEQ ID NO: 2029 - protein, 14 aa, Artificial
  CDR3 sequence
DSNVNTVKLGWGRY

SEQ ID NO: 2030 - protein, 15 aa, Artificial
  CDR3 sequence
DVRVAEKHTAYEANY

SEQ ID NO: 2031 - protein, 10 aa, Artificial
  CDR3 sequence
KMYGGNWYTY

SEQ ID NO: 2032 - protein, 19 aa, Artificial
  CDR3 sequence
ATSPLFVASDYFDASRYDY

SEQ ID NO: 2033 - protein, 19 aa, Artificial
  CDR3 sequence
AASTLFIASDYFEASRYDY

SEQ ID NO: 2034 - protein, 18 aa, Artificial
  CDR3 sequence
TSPLFVASDYFEASRYGY

SEQ ID NO: 2035 - protein, 18 aa, Artificial
  CDR3 sequence
ASPLFVASDYFEASRYGY

SEQ ID NO: 2036 - protein, 19 aa, Artificial
  CDR3 sequence
AASTLFVASDYFEASRYDY

SEQ ID NO: 2037 - protein, 18 aa, Artificial
  CDR3 sequence
TSPLFVASDYFEASRYGY

SEQ ID NO: 2038 - protein, 15 aa, Artificial
  CDR3 sequence
DNTAYGSFKADDYDY

SEQ ID NO: 2039 - protein, 15 aa, Artificial
  CDR3 sequence
DSTAYGSFKADDYDY

SEQ ID NO: 2040 - protein, 15 aa, Artificial
  CDR3 sequence
DSTAYGSFKADDYDY

SEQ ID NO: 2041 - protein, 19 aa, Artificial
  CDR3 sequence
DLTDSLCSYYDYMRPENDY

SEQ ID NO: 2042 - protein, 19 aa, Artificial
  CDR3 sequence
DLTDSLCSYYHYMRPENDY

SEQ ID NO: 2043 - protein, 19 aa, Artificial
  CDR3 sequence
NSDTYYIYSDIVVPERYDY

SEQ ID NO: 2044 - protein, 12 aa, Artificial
  CDR3 sequence
GSEPYYTNTYDY

SEQ ID NO: 2045 - protein, 18 aa, Artificial
  CDR3 sequence
DISSGNSGSYIYTWAYDY

SEQ ID NO: 2046 - protein, 18 aa, Artificial
  CDR3 sequence
DLTSTNPGSYIYIWAYDY

SEQ ID NO: 2047 - protein, 18 aa, Artificial
  CDR3 sequence
DISSGNSGSYIYTWAYDY

SEQ ID NO: 2048 - protein, 18 aa, Artificial
  CDR3 sequence
DISSGNSGSYIYTWAYDY

SEQ ID NO: 2049 - protein, 18 aa, Artificial
  CDR3 sequence
DISSGNSGSYIYTWAYDY

SEQ ID NO: 2050 - protein, 12 aa, Artificial
  CDR3 sequence
DGVLATTLNWDY

SEQ ID NO: 2051 - protein, 12 aa, Artificial
  CDR3 sequence
DGVLATTLNWDY

SEQ ID NO: 2052 - protein, 15 aa, Artificial
  CDR3 sequence
ALLGENLQWKGAYDY

SEQ ID NO: 2053 - protein, 18 aa, Artificial
  CDR3 sequence
DYSHTFVYPSMVPYESDY

SEQ ID NO: 2054 - protein, 15 aa, Artificial
  CDR3 sequence
GMSPNIEYAQGPVAY

SEQ ID NO: 2055 - protein, 19 aa, Artificial
  CDR3 sequence
DHKASGSYSSLSRPEEYDY

SEQ ID NO: 2056 - protein, 19 aa, Artificial
  CDR3 sequence
LFGTSSCTYYSRRKYEYDY

SEQ ID NO: 2057 - protein, 14 aa, Artificial
  CDR3 sequence
AHNTMGSDYEGYDY

SEQ ID NO: 2058 - protein, 21 aa, Artificial
  CDR3 sequence
SRRGGSRWYGLSGSCYYGMDY

SEQ ID NO: 2059 - protein, 15 aa, Artificial
  CDR3 sequence
DPYGSSWYGSPVYDY

SEQ ID NO: 2060 - protein, 19 aa, Artificial
  CDR3 sequence
GRSLYAKGSWWLISSEYDY

SEQ ID NO: 2061 - protein, 10 aa, Artificial
  CDR3 sequence
RWYSSMWYEY

SEQ ID NO: 2062 - protein, 18 aa, Artificial
  CDR3 sequence
PISSYVGGNYYSAAFYHY

SEQ ID NO: 2063 - protein, 17 aa, Artificial
  CDR3 sequence
GTPLNPGAYIYDWSYDY

SEQ ID NO: 2064 - protein, 17 aa, Artificial
  CDR3 sequence
DTPLNPGAYIYDWSYDY

SEQ ID NO: 2065 - protein, 22 aa, Artificial
  CDR3 sequence
DHSRVYYRDYRQGRLCEEPYDY

SEQ ID NO: 2066 - protein, 19 aa, Artificial
  CDR3 sequence
DARPAPYITNYKDPRAYDY

SEQ ID NO: 2067 - protein, 19 aa, Artificial
  CDR3 sequence
GFQYYSTITNYARERDYDY

SEQ ID NO: 2068 - protein, 14 aa, Artificial
  CDR3 sequence
DQPPSTWLVEYFDY

SEQ ID NO: 2069 - protein, 14 aa, Artificial
  CDR3 sequence
DQPPSTWLAEYFDY

SEQ ID NO: 2070 - protein, 14 aa, Artificial
  CDR3 sequence
DQPPSTWLVEYFDY

SEQ ID NO: 2071 - protein, 14 aa, Artificial
  CDR3 sequence
DQPPSTWLVEYFDY

SEQ ID NO: 2072 - protein, 18 aa, Artificial
  CDR3 sequence
DTASWNSGSFIYDWAYDH

SEQ ID NO: 2073 - protein, 17 aa, Artificial
  CDR3 sequence
KENGMFITATQEQSYDY

SEQ ID NO: 2074 - protein, 17 aa, Artificial
  CDR3 sequence
DTQFSGYVPKETNEYDY

SEQ ID NO: 2075 - protein, 14 aa, Artificial
  CDR3 sequence
DYTSSCPIYSGTDY

SEQ ID NO: 2076 - protein, 20 aa, Artificial
  CDR3 sequence
DFSLAQYKTIHTMPPYAMDY

SEQ ID NO: 2077 - protein, 18 aa, Artificial
  CDR3 sequence
SSRIYVYSDSLSEGSYDY

SEQ ID NO: 2078 - protein, 17 aa, Artificial
  CDR3 sequence
NPSYVYSDYLSLAGYTY

SEQ ID NO: 2079 - protein, 18 aa, Artificial
  CDR3 sequence
NRDSGTSYITFSLTDFAS

SEQ ID NO: 2080 - protein, 16 aa, Artificial
  CDR3 sequence
RKYYIHSDVVGNDYPY

SEQ ID NO: 2081 - protein, 20 aa, Artificial
  CDR3 sequence
DSLGGFRSASDYYNTNTYAY

SEQ ID NO: 2082 - protein, 14 aa, Artificial
  CDR3 sequence
DPSDWTCNVLEYDY

SEQ ID NO: 2083 - protein, 3 aa, Artificial
  CDR3 sequence
HNY

SEQ ID NO: 2084 - protein, 18 aa, Artificial
  CDR3 sequence
GSGILNSGSYYYPWVYEY

SEQ ID NO: 2085 - protein, 18 aa, Artificial
  CDR3 sequence
EGLIIATMDGGVNNDMDY

SEQ ID NO: 2086 - protein, 7 aa, Artificial
  CDR3 sequence
RDYEGNH

SEQ ID NO: 2087 - protein, 14 aa, Artificial
  CDR3 sequence
ALLLLPTTPSRVDY

SEQ ID NO: 2088 - protein, 14 aa, Artificial
  CDR3 sequence
ALLLLPTTPSRVDY

SEQ ID NO: 2089 - protein, 14 aa, Artificial
  CDR3 sequence
ALLLLPTTPSRVDY

SEQ ID NO: 2090 - protein, 14 aa, Artificial
  CDR3 sequence
ALLLLPTSPSRVDY

SEQ ID NO: 2091 - protein, 14 aa, Artificial
  CDR3 sequence
ALLLLPTTPSRVDY

SEQ ID NO: 2092 - protein, 17 aa, Artificial
  CDR3 sequence
YWAPWPMDVSRLDDYDN

SEQ ID NO: 2093 - protein, 18 aa, Artificial
  CDR3 sequence
DSTNRNSGAIYYPWAYDY

SEQ ID NO: 2094 - protein, 18 aa, Artificial
  CDR3 sequence
DSTNRNSGAVYYTWAYDY

SEQ ID NO: 2095 - protein, 18 aa, Artificial
  CDR3 sequence
DSTNRNSGAYYYTWAYDH

SEQ ID NO: 2096 - protein, 18 aa, Artificial
  CDR3 sequence
DTDSSNSGSYLYTWAYDY

SEQ ID NO: 2097 - protein, 18 aa, Artificial
  CDR3 sequence
DVSSTNSGSYIYTWAYDY

SEQ ID NO: 2098 - protein, 18 aa, Artificial
  CDR3 sequence
DASSTNSGSFIYTWAYDY

SEQ ID NO: 2099 - protein, 18 aa, Artificial
  CDR3 sequence
DATNRNSGAYFYTWAYDY

SEQ ID NO: 2100 - protein, 11 aa, Artificial
  Framework sequence
WGRGTQVTVSS

SEQ ID NO: 2101 - protein, 11 aa, Artificial
  Framework sequence
WGQGTQVTVSS

SEQ ID NO: 2102 - protein, 11 aa, Artificial
  Framework sequence
NSQGTQVTVSS

SEQ ID NO: 2103 - protein, 11 aa, Artificial
  Framework sequence
KGQGTQVTVSS

SEQ ID NO: 2104 - protein, 11 aa, Artificial
  Framework sequence
KGQGTQVTVSS

SEQ ID NO: 2105 - protein, 11 aa, Artificial
  Framework sequence
KGQGTQVTVSS

SEQ ID NO: 2106 - protein, 11 aa, Artificial
  Framework sequence
RGQGTQVTVSS

SEQ ID NO: 2107 - protein, 11 aa, Artificial
  Framework sequence
KGQGTQVTVSS

SEQ ID NO: 2108 - protein, 11 aa, Artificial
  Framework sequence
NSQGTQVTVSS

SEQ ID NO: 2109 - protein, 11 aa, Artificial
  Framework sequence
KGQGTQVTVSS

SEQ ID NO: 2110 - protein, 11 aa, Artificial
  Framework sequence
NSQGTQVTVSS

SEQ ID NO: 2111 - protein, 11 aa, Artificial
  Framework sequence
KGQGTQVTVSS

SEQ ID NO: 2112 - protein, 11 aa, Artificial
  Framework sequence
RSQGTQVTVSS

SEQ ID NO: 2113 - protein, 11 aa, Artificial
  Framework sequence
KGQGTQVTVSS

SEQ ID NO: 2114 - protein, 11 aa, Artificial
  Framework sequence
WGRGTQVTVSS

SEQ ID NO: 2115 - protein, 11 aa, Artificial
  Framework sequence
KGQGTQVTVSS

SEQ ID NO: 2116 - protein, 11 aa, Artificial
  Framework sequence
KGQGTQVTVSS

SEQ ID NO: 2117 - protein, 11 aa, Artificial
  Framework sequence
KGQGTQVTVSS

SEQ ID NO: 2118 - protein, 11 aa, Artificial
  Framework sequence
NSQGTQVTVSS

SEQ ID NO: 2119 - protein, 11 aa, Artificial
  Framework sequence
NSQGTQVTVSS

SEQ ID NO: 2120 - protein, 11 aa, Artificial
  Framework sequence
WGEGTQVTVSS

SEQ ID NO: 2121 - protein, 11 aa, Artificial
  Framework sequence
KGQGTQVTVSS

SEQ ID NO: 2122 - protein, 11 aa, Artificial
  Framework sequence
KGQGTQVTVSS

SEQ ID NO: 2123 - protein, 11 aa, Artificial
  Framework sequence
KGQGTQVTVSS

SEQ ID NO: 2124 - protein, 11 aa, Artificial
  Framework sequence
NSQGTQVTVSS

SEQ ID NO: 2125 - protein, 11 aa, Artificial
  Framework sequence
NSQGTQVTVSS

SEQ ID NO: 2126 - protein, 11 aa, Artificial
  Framework sequence
WGQGTQVTVSS

SEQ ID NO: 2127 - protein, 11 aa, Artificial
  Framework sequence
KGQGTQVTVSS

SEQ ID NO: 2128 - protein, 11 aa, Artificial
  Framework sequence
WGQGTQVTVSS

SEQ ID NO: 2129 - protein, 11 aa, Artificial
  Framework sequence
KGQGTQVTVSS

SEQ ID NO: 2130 - protein, 11 aa, Artificial
  Framework sequence
NSQGTQVTVSS

SEQ ID NO: 2131 - protein, 11 aa, Artificial
  Framework sequence
KGQGTQVTVSS

SEQ ID NO: 2132 - protein, 11 aa, Artificial
  Framework sequence
WGQGTQVTVSS

SEQ ID NO: 2133 - protein, 11 aa, Artificial
  Framework sequence
WGQGTQVTVSS

SEQ ID NO: 2134 - protein, 11 aa, Artificial
  Framework sequence
WGQGTQVTVSS

SEQ ID NO: 2135 - protein, 11 aa, Artificial
  Framework sequence
WGKGTLVTVSS

SEQ ID NO: 2136 - protein, 11 aa, Artificial
  Framework sequence
WGQGTQVTVSS

SEQ ID NO: 2137 - protein, 11 aa, Artificial
  Framework sequence
WGQGTQVTVSS

SEQ ID NO: 2138 - protein, 11 aa, Artificial
  Framework sequence
WGQGTQVTVSS

SEQ ID NO: 2139 - protein, 11 aa, Artificial
  Framework sequence
WGQGTQVTVSS

SEQ ID NO: 2140 - protein, 11 aa, Artificial
  Framework sequence
WGQGTQVTVSS

SEQ ID NO: 2141 - protein, 11 aa, Artificial
  Framework sequence
WGQGTQVTVSS

SEQ ID NO: 2142 - protein, 11 aa, Artificial
  Framework sequence
WGQGTQVTVSS

SEQ ID NO: 2143 - protein, 11 aa, Artificial
  Framework sequence
WGQGTQVTVSS

SEQ ID NO: 2144 - protein, 11 aa, Artificial
  Framework sequence
WGQGTQVTVSS

SEQ ID NO: 2145 - protein, 11 aa, Artificial
  Framework sequence
WGQGTQVTVSS

SEQ ID NO: 2146 - protein, 11 aa, Artificial
  Framework sequence
WGQGTQVTVSS

SEQ ID NO: 2147 - protein, 11 aa, Artificial
  Framework sequence
WGQGTQVTVSS

SEQ ID NO: 2148 - protein, 11 aa, Artificial
  Framework sequence
WGQGTQVTVSS

SEQ ID NO: 2149 - protein, 11 aa, Artificial
  Framework sequence
WGQGTQVTVSS

SEQ ID NO: 2150 - protein, 11 aa, Artificial
  Framework sequence
WGQGTQVTVSS

SEQ ID NO: 2151 - protein, 11 aa, Artificial
  Framework sequence
WGQGTQVTVSS

SEQ ID NO: 2152 - protein, 11 aa, Artificial
  Framework sequence
WGQGTQVTVSS

SEQ ID NO: 2153 - protein, 11 aa, Artificial
  Framework sequence
WGQGTQVTVSS

SEQ ID NO: 2154 - protein, 11 aa, Artificial
  Framework sequence
WGQGTQVTVSS

SEQ ID NO: 2155 - protein, 11 aa, Artificial
  Framework sequence
WGQGTQVTVSS

SEQ ID NO: 2156 - protein, 11 aa, Artificial
  Framework sequence
WGQGTQVTVSS

SEQ ID NO: 2157 - protein, 11 aa, Artificial
  Framework sequence
WGQGTQVTVSS

SEQ ID NO: 2158 - protein, 11 aa, Artificial
  Framework sequence
WGQGTQVTVSS

SEQ ID NO: 2159 - protein, 11 aa, Artificial
  Framework sequence
WGKGTLVTVSS

SEQ ID NO: 2160 - protein, 11 aa, Artificial
  Framework sequence
WGQGTQVTVSS

SEQ ID NO: 2161 - protein, 11 aa, Artificial
  Framework sequence
WGQGTQVTVSS

SEQ ID NO: 2162 - protein, 11 aa, Artificial
  Framework sequence
WGQGTQVTVSS

SEQ ID NO: 2163 - protein, 11 aa, Artificial
  Framework sequence
WGQGTQVTVSS

SEQ ID NO: 2164 - protein, 11 aa, Artificial
  Framework sequence
WGQGTQVTVSS

SEQ ID NO: 2165 - protein, 11 aa, Artificial
  Framework sequence
WGQGTQVTVSS

SEQ ID NO: 2166 - protein, 11 aa, Artificial
  Framework sequence
WGQGTQVTVSS

SEQ ID NO: 2167 - protein, 11 aa, Artificial
  Framework sequence
WGQGTQVTVSS

SEQ ID NO: 2168 - protein, 11 aa, Artificial
  Framework sequence
WGQGTQVTVSS

SEQ ID NO: 2169 - protein, 11 aa, Artificial
  Framework sequence
WGQGTQVTVSS

SEQ ID NO: 2170 - protein, 11 aa, Artificial
  Framework sequence
WGQGTRVTVSS

SEQ ID NO: 2171 - protein, 11 aa, Artificial
  Framework sequence
WGRGTQVTVSS

SEQ ID NO: 2172 - protein, 11 aa, Artificial
  Framework sequence
WGQGTQVTVSS

SEQ ID NO: 2173 - protein, 11 aa, Artificial
  Framework sequence
WGRGTQVTVSS

SEQ ID NO: 2174 - protein, 11 aa, Artificial
  Framework sequence
RGQGTQVTVSS

SEQ ID NO: 2175 - protein, 11 aa, Artificial
  Framework sequence
WGQGTQVTVSS

SEQ ID NO: 2176 - protein, 11 aa, Artificial
  Framework sequence
WGKGTLVTVSS

SEQ ID NO: 2177 - protein, 11 aa, Artificial
  Framework sequence
WGQGTQVTVSS

SEQ ID NO: 2178 - protein, 11 aa, Artificial
  Framework sequence
WGQGTQVTVSS

SEQ ID NO: 2179 - protein, 11 aa, Artificial
  Framework sequence
RGQGTQVTVSS

SEQ ID NO: 2180 - protein, 11 aa, Artificial
  Framework sequence
WGQGTQVTVSS

SEQ ID NO: 2181 - protein, 11 aa, Artificial
  Framework sequence
RGQGTQVTVSS

SEQ ID NO: 2182 - protein, 11 aa, Artificial
  Framework sequence
WGQGTQVTVSS

SEQ ID NO: 2183 - protein, 11 aa, Artificial
  Framework sequence
WGQGTQVTVSS

SEQ ID NO: 2184 - protein, 11 aa, Artificial
  Framework sequence
WGQGTQVTVSS

SEQ ID NO: 2185 - protein, 11 aa, Artificial
  Framework sequence
WGQGTQVTVSS

SEQ ID NO: 2186 - protein, 11 aa, Artificial
  Framework sequence
WGQGTQVTVSS

SEQ ID NO: 2187 - protein, 11 aa, Artificial
  Framework sequence
WGQGTQVTVSS

SEQ ID NO: 2188 - protein, 11 aa, Artificial
  Framework sequence
WGQGTQVTVSS

SEQ ID NO: 2189 - protein, 11 aa, Artificial
  Framework sequence
WGQGTQVTVSS

SEQ ID NO: 2190 - protein, 11 aa, Artificial
  Framework sequence
WGQGTQVTVSS

SEQ ID NO: 2191 - protein, 11 aa, Artificial
  Framework sequence
WGQGTQVTVSS

SEQ ID NO: 2192 - protein, 11 aa, Artificial
  Framework sequence
WGQGTQVTVSS

SEQ ID NO: 2193 - protein, 11 aa, Artificial
  Framework sequence
WGQGTQVTVSS

SEQ ID NO: 2194 - protein, 11 aa, Artificial
  Framework sequence
WGQGTQVTVSS

SEQ ID NO: 2195 - protein, 11 aa, Artificial
  Framework sequence
WGQGTQVTVSS

SEQ ID NO: 2196 - protein, 11 aa, Artificial
  Framework sequence
WGQGTQVTVSS

SEQ ID NO: 2197 - protein, 11 aa, Artificial
  Framework sequence
WGQGTQVTVSS

SEQ ID NO: 2198 - protein, 11 aa, Artificial
  Framework sequence
WGQGTQVTVSS

SEQ ID NO: 2199 - protein, 11 aa, Artificial
  Framework sequence
WGQGTQVTVSS

SEQ ID NO: 2200 - protein, 11 aa, Artificial
  Framework sequence
WGKGTLVTVSS

SEQ ID NO: 2201 - protein, 11 aa, Artificial
  Framework sequence
WGQGTQVTVSS

SEQ ID NO: 2202 - protein, 11 aa, Artificial
  Framework sequence
WGQGTQVTVSS

SEQ ID NO: 2203 - protein, 11 aa, Artificial
  Framework sequence
WGQGTQVTVSS

SEQ ID NO: 2204 - protein, 11 aa, Artificial
  Framework sequence
WGQGTQVTVSS

SEQ ID NO: 2205 - protein, 11 aa, Artificial
  Framework sequence
WGQGTQVTVSS

SEQ ID NO: 2206 - protein, 11 aa, Artificial
  Framework sequence
WGQGTQVTVSS

SEQ ID NO: 2207 - protein, 11 aa, Artificial
  Framework sequence
WGQGTQVTVSS

SEQ ID NO: 2208 - protein, 11 aa, Artificial
  Framework sequence
RGQGTQVTVSS

SEQ ID NO: 2209 - protein, 11 aa, Artificial
  Framework sequence
WGQGTQVTVSS

SEQ ID NO: 2210 - protein, 11 aa, Artificial
  Framework sequence
WGQGIQVTVSS

SEQ ID NO: 2211 - protein, 11 aa, Artificial
  Framework sequence
WGKGTLVTVSS

SEQ ID NO: 2212 - protein, 11 aa, Artificial
  Framework sequence
WGQGTQVTVSS

SEQ ID NO: 2213 - protein, 11 aa, Artificial
  Framework sequence
WGKGTLVTVSS

SEQ ID NO: 2214 - protein, 11 aa, Artificial
  Framework sequence
WGLGTQVTVSS

SEQ ID NO: 2215 - protein, 11 aa, Artificial
  Framework sequence
WGPGTQVTVSS

SEQ ID NO: 2216 - protein, 11 aa, Artificial
  Framework sequence
WGQGTQVTVSS

SEQ ID NO: 2217 - protein, 11 aa, Artificial
  Framework sequence
WGQGTQVTVSS

SEQ ID NO: 2218 - protein, 11 aa, Artificial
  Framework sequence
WGQGTQVTVSS

SEQ ID NO: 2219 - protein, 11 aa, Artificial
  Framework sequence
WGQGTQVTVSS

SEQ ID NO: 2220 - protein, 11 aa, Artificial
  Framework sequence
WGQGTQVTVSS

SEQ ID NO: 2221 - protein, 11 aa, Artificial
  Framework sequence
WGQGTQVTVSS

SEQ ID NO: 2222 - protein, 11 aa, Artificial
  Framework sequence
WGQGTQVTVSS

SEQ ID NO: 2223 - protein, 11 aa, Artificial
  Framework sequence
WGQGTQVTVSS

SEQ ID NO: 2224 - protein, 11 aa, Artificial
  Framework sequence
WGQGTQVTVSS

SEQ ID NO: 2225 - protein, 11 aa, Artificial
  Framework sequence
WGQGTQVTVSS

SEQ ID NO: 2226 - protein, 11 aa, Artificial
  Framework sequence
WGQGTQVTVSS

SEQ ID NO: 2227 - protein, 11 aa, Artificial
  Framework sequence
KGQGTQVTVSS

SEQ ID NO: 2228 - protein, 11 aa, Artificial
  Framework sequence
KGQGTQVTVSS

SEQ ID NO: 2229 - protein, 11 aa, Artificial
  Framework sequence
KGQGTQVTVSS

SEQ ID NO: 2230 - protein, 11 aa, Artificial
  Framework sequence
KGQGTQVTVSS

SEQ ID NO: 2231 - protein, 11 aa, Artificial
  Framework sequence
KGQGTQVTVSS

SEQ ID NO: 2232 - protein, 11 aa, Artificial
  Framework sequence
KGQGTQVTVSS

SEQ ID NO: 2233 - protein, 11 aa, Artificial
  Framework sequence
KGQGTQVTVSS

SEQ ID NO: 2234 - protein, 11 aa, Artificial
  Framework sequence
KGQGTQVTVSS

SEQ ID NO: 2235 - protein, 11 aa, Artificial
  Framework sequence
KGRGTQVTVSS

SEQ ID NO: 2236 - protein, 11 aa, Artificial
  Framework sequence
WGQGTQVTVSS

SEQ ID NO: 2237 - protein, 11 aa, Artificial
  Framework sequence
WGQGTQVTVSS

SEQ ID NO: 2238 - protein, 11 aa, Artificial
  Framework sequence
WGQGTQVTVSS

SEQ ID NO: 2239 - protein, 11 aa, Artificial
  Framework sequence
WGQGTQVTVSS

SEQ ID NO: 2240 - protein, 11 aa, Artificial
  Framework sequence
YGQGTQVTVSS

SEQ ID NO: 2241 - protein, 11 aa, Artificial
  Framework sequence
WGQGTQVTVSS

SEQ ID NO: 2242 - protein, 11 aa, Artificial
  Framework sequence
WGQGTQVTVSS

SEQ ID NO: 2243 - protein, 11 aa, Artificial
  Framework sequence
WGQGTQVTVSS

SEQ ID NO: 2244 - protein, 11 aa, Artificial
  Framework sequence
WGQGTQVTVSS

SEQ ID NO: 2245 - protein, 11 aa, Artificial
  Framework sequence
WGQGTQVTVSS

SEQ ID NO: 2246 - protein, 11 aa, Artificial
  Framework sequence
WGQGTQVTVSS

SEQ ID NO: 2247 - protein, 11 aa, Artificial
  Framework sequence
WGQGTQVTVSS

SEQ ID NO: 2248 - protein, 11 aa, Artificial
  Framework sequence
WGQGTQVTVSS

SEQ ID NO: 2249 - protein, 11 aa, Artificial
  Framework sequence
WGQGTQVTVSS

SEQ ID NO: 2250 - protein, 11 aa, Artificial
  Framework sequence
WGQGTQVTVSS

SEQ ID NO: 2251 - protein, 11 aa, Artificial
  Framework sequence
WGQGTQVTVSS

SEQ ID NO: 2252 - protein, 11 aa, Artificial
  Framework sequence
WGQGTQVTVSS

SEQ ID NO: 2253 - protein, 11 aa, Artificial
  Framework sequence
WGQGTQVTVSS

SEQ ID NO: 2254 - protein, 11 aa, Artificial
  Framework sequence
WGQGTQVTVSS

SEQ ID NO: 2255 - protein, 11 aa, Artificial
  Framework sequence
WGQGTQVTVSS

SEQ ID NO: 2256 - protein, 11 aa, Artificial
  Framework sequence
WGQGTQVTVSS

SEQ ID NO: 2257 - protein, 11 aa, Artificial
  Framework sequence
WGQGTQVTVSS

SEQ ID NO: 2258 - protein, 11 aa, Artificial
  Framework sequence
WGQGTQVTVSS

SEQ ID NO: 2259 - protein, 11 aa, Artificial
  Framework sequence
WGQGTQVTVSS

SEQ ID NO: 2260 - protein, 11 aa, Artificial
  Framework sequence
WGQGTQVTVSS

SEQ ID NO: 2261 - protein, 11 aa, Artificial
  Framework sequence
WGQGTQVTVSS

SEQ ID NO: 2262 - protein, 11 aa, Artificial
  Framework sequence
WGQGTQVTVSS

SEQ ID NO: 2263 - protein, 11 aa, Artificial
  Framework sequence
WGQGTQVTVSS

SEQ ID NO: 2264 - protein, 11 aa, Artificial
  Framework sequence
WGQGTQVTVSS

SEQ ID NO: 2265 - protein, 11 aa, Artificial
  Framework sequence
WGQGTQVTVSS

SEQ ID NO: 2266 - protein, 11 aa, Artificial
  Framework sequence
WGQGTQVTVSS

SEQ ID NO: 2267 - protein, 11 aa, Artificial
  Framework sequence
WGQGTQVTVSS

SEQ ID NO: 2268 - protein, 11 aa, Artificial
  Framework sequence
WGQGTQVTVSS

SEQ ID NO: 2269 - protein, 11 aa, Artificial
  Framework sequence
WGQGTQVTVSS

SEQ ID NO: 2270 - protein, 11 aa, Artificial
  Framework sequence
WGQGTQVTVSS

SEQ ID NO: 2271 - protein, 11 aa, Artificial
  Framework sequence
WGQGTQVTVSS

SEQ ID NO: 2272 - protein, 11 aa, Artificial
  Framework sequence
WGQGTQVTVSS

SEQ ID NO: 2273 - protein, 11 aa, Artificial
  Framework sequence
WGQGTQVTVSS

SEQ ID NO: 2274 - protein, 11 aa, Artificial
  Framework sequence
WGQGTQVTVSS

SEQ ID NO: 2275 - protein, 11 aa, Artificial
  Framework sequence
WGQGTQVTVSS

SEQ ID NO: 2276 - protein, 11 aa, Artificial
  Framework sequence
WGQGTQVTVSS

SEQ ID NO: 2277 - protein, 11 aa, Artificial
  Framework sequence
WGQGTQVTVSS

SEQ ID NO: 2278 - protein, 11 aa, Artificial
  Framework sequence
WGQGTQVTVSS

SEQ ID NO: 2279 - protein, 11 aa, Artificial
  Framework sequence
WGQGTQVTVSS

SEQ ID NO: 2280 - protein, 11 aa, Artificial
  Framework sequence
WGQGTQVTVSS

SEQ ID NO: 2281 - protein, 11 aa, Artificial
  Framework sequence
WGQGTQVTVSS

SEQ ID NO: 2282 - protein, 11 aa, Artificial
  Framework sequence
WGQGTQVTVSS

SEQ ID NO: 2283 - protein, 11 aa, Artificial
  Framework sequence
WGQGTQVTVSS

SEQ ID NO: 2284 - protein, 11 aa, Artificial
  Framework sequence
WGQGTQVTVSS

SEQ ID NO: 2285 - protein, 11 aa, Artificial
  Framework sequence
WGQGTQVTVSS

SEQ ID NO: 2286 - protein, 11 aa, Artificial
  Framework sequence
WGQGTQVTVSS

SEQ ID NO: 2287 - protein, 11 aa, Artificial
  Framework sequence
WGQGTQVTVSS

SEQ ID NO: 2288 - protein, 11 aa, Artificial
  Framework sequence
WGQGTQVTVSS

SEQ ID NO: 2289 - protein, 11 aa, Artificial
  Framework sequence
WGQGTQVTVSS

SEQ ID NO: 2290 - protein, 11 aa, Artificial
  Framework sequence
WGKGTLVTVSS

SEQ ID NO: 2291 - protein, 11 aa, Artificial
  Framework sequence
WGKGTLVTVSS

SEQ ID NO: 2292 - protein, 11 aa, Artificial
  Framework sequence
RGKGTLVTVSS

SEQ ID NO: 2293 - protein, 11 aa, Artificial
  Framework sequence
WGKGTLVTVSS

SEQ ID NO: 2294 - protein, 11 aa, Artificial
  Framework sequence
RGKGTLVTVSS

SEQ ID NO: 2295 - protein, 11 aa, Artificial
  Framework sequence
WGKGTLVTVSS

SEQ ID NO: 2296 - protein, 11 aa, Artificial
  Framework sequence
WGKGTLVTVSS

SEQ ID NO: 2297 - protein, 11 aa, Artificial
  Framework sequence
WGKGTLVTVSS

SEQ ID NO: 2298 - protein, 11 aa, Artificial
  Framework sequence
WGKGTLVTVSS

SEQ ID NO: 2299 - protein, 11 aa, Artificial
  Framework sequence
WGKGTLVTVSS

SEQ ID NO: 2300 - protein, 11 aa, Artificial
  Framework sequence
WGKGTLVTVSS

SEQ ID NO: 2301 - protein, 11 aa, Artificial
  Framework sequence
WGKGTLVTVSS

SEQ ID NO: 2302 - protein, 11 aa, Artificial
  Framework sequence
WGQGTQVTVSS

SEQ ID NO: 2303 - protein, 11 aa, Artificial
  Framework sequence
WGQGTQVTVSS

SEQ ID NO: 2304 - protein, 11 aa, Artificial
  Framework sequence
WGQGTQVTVSS

SEQ ID NO: 2305 - protein, 11 aa, Artificial
  Framework sequence
WGQGTQVTVSS

SEQ ID NO: 2306 - protein, 11 aa, Artificial
  Framework sequence
WGRGTRVTVSS

SEQ ID NO: 2307 - protein, 11 aa, Artificial
  Framework sequence
WGQGTQVTVSS

SEQ ID NO: 2308 - protein, 11 aa, Artificial
  Framework sequence
WGQGTQVTVSS

SEQ ID NO: 2309 - protein, 11 aa, Artificial
  Framework sequence
WGQGTQVTVSS

SEQ ID NO: 2310 - protein, 11 aa, Artificial
  Framework sequence
WGQGTQVTVSS

SEQ ID NO: 2311 - protein, 11 aa, Artificial
  Framework sequence
WGQGTQVTVSS

SEQ ID NO: 2312 - protein, 11 aa, Artificial
  Framework sequence
WGQGTQVTVSS

SEQ ID NO: 2313 - protein, 11 aa, Artificial
  Framework sequence
WGQGTQVTVSS

SEQ ID NO: 2314 - protein, 11 aa, Artificial
  Framework sequence
WGQGTQVTVSS

SEQ ID NO: 2315 - protein, 11 aa, Artificial
  Framework sequence
WGQGTQVTVSS

SEQ ID NO: 2316 - protein, 11 aa, Artificial
  Framework sequence
WGQGTQVTVSS

SEQ ID NO: 2317 - protein, 11 aa, Artificial
  Framework sequence
WGQGTQVTVSS

SEQ ID NO: 2318 - protein, 11 aa, Artificial
  Framework sequence
WGQGTQVTVSS

SEQ ID NO: 2319 - protein, 11 aa, Artificial
  Framework sequence
WGQGTQVTVSS

SEQ ID NO: 2320 - protein, 11 aa, Artificial
  Framework sequence
WGQGTQVTVSS

SEQ ID NO: 2321 - protein, 11 aa, Artificial
  Framework sequence
WGQGTQVTVSS

SEQ ID NO: 2322 - protein, 11 aa, Artificial
  Framework sequence
WGQGTQVTVSS

SEQ ID NO: 2323 - protein, 11 aa, Artificial
  Framework sequence
WGQGTQVTVSS

SEQ ID NO: 2324 - protein, 11 aa, Artificial
  Framework sequence
WGQGTQVTVSS

SEQ ID NO: 2325 - protein, 11 aa, Artificial
  Framework sequence
WGQGTQVTVSS

SEQ ID NO: 2326 - protein, 11 aa, Artificial
  Framework sequence
WGQGTQVTVSS

SEQ ID NO: 2327 - protein, 11 aa, Artificial
  Framework sequence
WGQGTQVTVSS

SEQ ID NO: 2328 - protein, 11 aa, Artificial
  Framework sequence
WGQGTQVTVSS

SEQ ID NO: 2329 - protein, 11 aa, Artificial
  Framework sequence
WGQGTQVTVSS

SEQ ID NO: 2330 - protein, 11 aa, Artificial
  Framework sequence
WGQGTQVTVSS

SEQ ID NO: 2331 - protein, 11 aa, Artificial
  Framework sequence
WGQGTQVTVSS

SEQ ID NO: 2332 - protein, 11 aa, Artificial
  Framework sequence
WGQGTQVTVSS

SEQ ID NO: 2333 - protein, 11 aa, Artificial
  Framework sequence
WGQGTQVTVSS

SEQ ID NO: 2334 - protein, 11 aa, Artificial
  Framework sequence
WGQGTQVTVSS

SEQ ID NO: 2335 - protein, 11 aa, Artificial
  Framework sequence
WGQGTQVTVSS

SEQ ID NO: 2336 - protein, 11 aa, Artificial
  Framework sequence
RGQGTQVTVSS

SEQ ID NO: 2337 - protein, 11 aa, Artificial
  Framework sequence
WGQGTQVTVSS

SEQ ID NO: 2338 - protein, 11 aa, Artificial
  Framework sequence
WGQGTQVTVSS

SEQ ID NO: 2339 - protein, 11 aa, Artificial
  Framework sequence
WGQGTQVTVSS

SEQ ID NO: 2340 - protein, 11 aa, Artificial
  Framework sequence
WGKGTLVTVSS

SEQ ID NO: 2341 - protein, 11 aa, Artificial
  Framework sequence
WGQGTQVTVSS

SEQ ID NO: 2342 - protein, 11 aa, Artificial
  Framework sequence
WGQGTQVTVSS

SEQ ID NO: 2343 - protein, 11 aa, Artificial
  Framework sequence
WGQGTQVTVSS

SEQ ID NO: 2344 - protein, 11 aa, Artificial
  Framework sequence
WGQGTQVTVSS

SEQ ID NO: 2345 - protein, 11 aa, Artificial
  Framework sequence
WGRGTQVTVSS

SEQ ID NO: 2346 - protein, 11 aa, Artificial
  Framework sequence
WGRGTQVTVSS

SEQ ID NO: 2347 - protein, 11 aa, Artificial
  Framework sequence
WGQGTQVTVSS

SEQ ID NO: 2348 - protein, 11 aa, Artificial
  Framework sequence
WGQGTQVTVSS

SEQ ID NO: 2349 - protein, 11 aa, Artificial
  Framework sequence
WGQGTQVTVSS

SEQ ID NO: 2350 - protein, 11 aa, Artificial
  Framework sequence
WGQGTRVTVSS

SEQ ID NO: 2351 - protein, 11 aa, Artificial
  Framework sequence
WGQGTRVTVSS

SEQ ID NO: 2352 - protein, 11 aa, Artificial
  Framework sequence
WGQGTRVTVSS

SEQ ID NO: 2353 - protein, 11 aa, Artificial
  Framework sequence
WGQGTQVTVSS

SEQ ID NO: 2354 - protein, 11 aa, Artificial
  Framework sequence
WGQGTQVTVSS

SEQ ID NO: 2355 - protein, 11 aa, Artificial
  Framework sequence
WGQGTQVTVSS

SEQ ID NO: 2356 - protein, 11 aa, Artificial
  Framework sequence
WGQGTQVTVSS

SEQ ID NO: 2357 - protein, 11 aa, Artificial
  Framework sequence
WGKGTLVTVSS

SEQ ID NO: 2358 - protein, 11 aa, Artificial
  Framework sequence
WGKGTLVTVSS

SEQ ID NO: 2359 - protein, 11 aa, Artificial
  Framework sequence
WGRGTQVTVSS

SEQ ID NO: 2360 - protein, 11 aa, Artificial
  Framework sequence
WGQGTQVTVSS

SEQ ID NO: 2361 - protein, 11 aa, Artificial
  Framework sequence
WGQGTQVTVSS

SEQ ID NO: 2362 - protein, 11 aa, Artificial
  Framework sequence
WGQGTQVTVSS

SEQ ID NO: 2363 - protein, 11 aa, Artificial
  Framework sequence
WGQGTQVTVSS

SEQ ID NO: 2364 - protein, 11 aa, Artificial
  Framework sequence
WGQGTQVTVSS

SEQ ID NO: 2365 - protein, 11 aa, Artificial
  Framework sequence
WGQGTQVTVSS

SEQ ID NO: 2366 - protein, 11 aa, Artificial
  Framework sequence
WGQGTQVTVSS

SEQ ID NO: 2367 - protein, 11 aa, Artificial
  Framework sequence
WGKGTLVTVSS

SEQ ID NO: 2368 - protein, 11 aa, Artificial
  Framework sequence
WGQGTQVTVSS

SEQ ID NO: 2369 - protein, 11 aa, Artificial
  Framework sequence
WGQGTQVTVSS

SEQ ID NO: 2370 - protein, 11 aa, Artificial
  Framework sequence
WGQGTQVTVSS

SEQ ID NO: 2371 - protein, 11 aa, Artificial
  Framework sequence
WGQGTQVTVSS

SEQ ID NO: 2372 - protein, 11 aa, Artificial
  Framework sequence
WGQGTQVTVSS

SEQ ID NO: 2373 - protein, 11 aa, Artificial
  Framework sequence
WGQGTQVTVSS

SEQ ID NO: 2374 - protein, 11 aa, Artificial
  Framework sequence
KGQGTQVTVSS

SEQ ID NO: 2375 - protein, 11 aa, Artificial
  Framework sequence
WGQGTQVTVSS

SEQ ID NO: 2376 - protein, 11 aa, Artificial
  Framework sequence
WGQGTQVTVSS

SEQ ID NO: 2377 - protein, 11 aa, Artificial
  Framework sequence
WGQGTQVTVSS

SEQ ID NO: 2378 - protein, 11 aa, Artificial
  Framework sequence
WGQGTQVTVSS

SEQ ID NO: 2379 - protein, 11 aa, Artificial
  Framework sequence
WGQGTQVTVSS

SEQ ID NO: 2380 - protein, 11 aa, Artificial
  Framework sequence
WGQGTQVTVSS

SEQ ID NO: 2381 - protein, 11 aa, Artificial
  Framework sequence
WGQGTQVTVSS

SEQ ID NO: 2382 - protein, 294 aa, Artificial
  Nanobody sequence
EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGGSGGGGSEVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSAAAEQKLISEEDLNGAAHHHHHH

SEQ ID NO: 2383 - protein, 303 aa, Artificial
  Nanobody sequence
VQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGGSGGGGSGGGGSGGGGSEVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSAAAEQKLISEEDLNGAAHHHHHH

SEQ ID NO: 2384 - protein, 314 aa, Artificial
  Nanobody sequence
EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGGSGGGGSGGGGSGGGGSGGGGSGGGGSEVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSAAAEQKLISEEDLNGAAHHHHHH

SEQ ID NO: 2385 - protein, 288 aa, Artificial
  Nanobody sequence
EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGSEVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSAAAEQKLISEEDLNGAAHHHHHH

SEQ ID NO: 2386 - protein, 286 aa, Artificial
  Nanobody sequence
EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSAAAEQKLISEEDLNGAAHHHHHH

SEQ ID NO: 2387 - protein, 292 aa, Artificial
  Nanobody sequence
EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSAAAEQKLISEEDLNGAAHHHHHH

SEQ ID NO: 2388 - protein, 284 aa, Artificial
  Nanobody sequence
EVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSSGGGGSGGGSEVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSSAAAEQKLISEEDLNGAAHHHHHH

SEQ ID NO: 2389 - protein, 290 aa, Artificial
  Nanobody sequence
EVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSSGGGGSGGGGSGGGGSEVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSSAAAEQKLISEEDLNGAAHHHHHH

SEQ ID NO: 2390 - protein, 285 aa, Artificial
  Nanobody sequence
EVQLVESGGGLVQPGGSLRLSCAASGRTFSSIAMGWFRQAPGKEREFVAAISWSRGRTFYADSVKGRFIISRDDAANTAYLQMNSLKPEDTAVYYCAVDTASWNSGSFIYDWAYDHWGQGTQVTVSSGGGGSGGGSEVQLVESGGGLVQPGGSLRLSCAASGRTFSSIAMGWFRQAPGKEREFVAAISWSRGRTFYADSVKGRFIISRDDAANTAYLQMNSLKPEDTAVYYCAVDTASWNSGSFIYDWAYDHWGQGTQVTVSSAAAEQKLISEEDLNGAAHHHHH

SEQ ID NO: 2391 - protein, 292 aa, Artificial
  Nanobody sequence
EVQLVESGGGLVQPGGSLRLSCAASGRTFSSIAMGWFRQAPGKEREFVAAISWSRGRTFYADSVKGRFIISRDDAANTAYLQMNSLKPEDTAVYYCAVDTASWNSGSFIYDWAYDHWGQGTQVTVSSGGGGSGGGGSGGGGSEVQLVESGGGLVQPGGSLRLSCAASGRTFSSIAMGWFRQAPGKEREFVAAISWSRGRTFYADSVKGRFIISRDDAANTAYLQMNSLKPEDTAVYYCAVDTASWNSGSFIYDWAYDHWGQGTQVTVSSAAAEQKLISEEDLNGAAHHHHHH

SEQ ID NO: 2392 - protein, 290 aa, Artificial
  Nanobody sequence
EVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSSGGGGSGGGGSGGGGSEVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSSAAAEQKLISEEDLNGAAHHHHHH

SEQ ID NO: 2393 - protein, 285 aa, Artificial
  Nanobody sequence
EVQLVESGGGWVQAGGSLRLSCAASGRAFSSYAMGWIRQAPGKEREFVAGIDQSGESTAYGASASGRFIISRDNAKNTVHLLMNSLQSDDTAVYYCVADGVLATTLNWDYWGQGTQVTVSSGGGGSGGGGSGGGGSGGGGSEVQLVESGGGWVQAGGSLRLSCAASGRAFSSYAMGWIRQAPGKEREFVAGIDQSGESTAYGASASGRFIISRDNAKNTVHLLMNSLQSDDTAVYYCVADGVLATTLNWDYWGQGTQVTVSSAAAEQKLISEEDLNGAAHHHHHH

SEQ ID NO: 2394 - protein, 295 aa, Artificial
  Nanobody sequence
EVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSSGGGGSGGGGSGGGGGGGSEVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSSAAAEQKLISEEDLNGAAHHHHHH

SEQ ID NO: 2395 - protein, 290 aa, Artificial
  Nanobody sequence
EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGGSGGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSAAAEQKLISEEDLNGAAHHHHHH

SEQ ID NO: 2396 - protein, 287 aa, Artificial
  Nanobody sequence
EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGSEVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSSAAAEQKLISEEDLNGAAHHHHHH

SEQ ID NO: 2397 - protein, 293 aa, Artificial
  Nanobody sequence
EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGGSGGGGSEVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSSAAAEQKLISEEDLNGAAHHHHHH

SEQ ID NO: 2398 - protein, 303 aa, Artificial
  Nanobody sequence
EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGGSGGGGSGGGGSGGGGSEVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSSAAAEQKLISEEDLNGAAHHHHHH

SEQ ID NO: 2399 - protein, 291 aa, Artificial
  Nanobody sequence
EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSSAAAEQKLISEEDLNGAAHHHHHH

SEQ ID NO: 2400 - protein, 291 aa, Artificial
  Nanobody sequence
EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSSAAAEQKLISEEDLNGAAHHHHHH

SEQ ID NO: 2401 - protein, 291 aa, Artificial
  Nanobody sequence
EVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSAAAEQKLISEEDLNGAAHHHHHH

SEQ ID NO: 2402 - protein, 291 aa, Artificial; identical to SEQ ID NO: 2401
  Nanobody sequence

SEQ ID NO: 2403 - protein, 287 aa, Artificial
  Nanobody sequence
EVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSSGGGGSGGGSEVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSAAAEQKLISEEDLNGAAHHHHHH

SEQ ID NO: 2404 - protein, 293 aa, Artificial
  Nanobody sequence
EVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSSGGGGSGGGGSGGGGSEVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSAAAEQKLISEEDLNGAAHHHHHH

SEQ ID NO: 2405 - protein, 303 aa, Artificial
  Nanobody sequence
EVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSSGGGGSGGGGSGGGGSGGGGSGGGGSEVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSAAAEQKLISEEDLNGAAHHHHHH

SEQ ID NO: 2406 - protein, 291 aa, Artificial
  Nanobody sequence
EVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSAAAEQKLISEEDLNGAAHHHHHH

SEQ ID NO: 2407 - protein, 290 aa, Artificial
  Nanobody sequence
EVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSSGGGGSGGGGSGGGGSEVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSSAAAEQKLISEEDLNGAAHHHHHH

SEQ ID NO: 2408 - protein, 434 aa, Artificial
  Nanobody sequence
EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSAAAEQKLISEEDLNGAAHHHHHH

SEQ ID NO: 2409 - protein, 433 aa, Artificial
  Nanobody sequence
EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSSAAAEQKLISEEDLNGAAHHHHHH

SEQ ID NO: 2410 - protein, 433 aa, Artificial
  Nanobody sequence
EVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSAAAEQKLISEEDLNGAAHHHHHH

SEQ ID NO: 2411 - protein, 433 aa, Artificial
  Nanobody sequence
EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSAAAEQKLISEEDLNGAAHHHHHH

SEQ ID NO: 2412 - protein, 431 aa, Artificial
  Nanobody sequence
EVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSSGGGGSGGGGSGGGGSEVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSSGGGGSGGGGSGGGGSEVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSSAAAEQKLISEEDLNGAAHHHHHH

SEQ ID NO: 2413 - protein, 437 aa, Artificial
  Nanobody sequence
EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGGSGGGGSEVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGGSGGGGSEVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSAAAEQKLISEEDLNGAAHHHHHH

SEQ ID NO: 2414 - protein, 434 aa, Artificial
  Nanobody sequence
EVQLVESGGGLVQPGGSLRLSCAASGRTFSSIAMGWFRQAPGKEREFVAAISWSRGRTFYADSVKGRFIISRDDAANTAYLQMNSLKPEDTAVYYCAVDTASWNSGSFIYDWAYDHWGQGTQVTVSSGGGGSGGGGSGGGGSEVQLVESGGGLVQPGGSLRLSCAASGRTFSSIAMGWFRQAPGKEREFVAAISWSRGRTFYADSVKGRFIISRDDAANTAYLQMNSLKPEDTAVYYCAVDTASWNSGSFIYDWAYDHWGQGTQVTVSSGGGGSGGGGSGGGGSEVQLVESGGGLVQPGGSLRLSCAASGRTFSSIAMGWFRQAPGKEREFVAAISWSRGRTFYADSVKGRFIISRDDAANTAYLQMNSLKPEDTAVYYCAVDTASWNSGSFIYDWAYDHWGQGTQVTVSSAAAEQKLISEEDLNGAAHHHHHH

SEQ ID NO: 2415 - protein, 431 aa, Artificial
  Nanobody sequence
EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGGSGGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGGSGGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSAAAEQKLISEEDLNGAAHHHHHH

SEQ ID NO: 2416 - protein, 574 aa, respiratory syncytial virus
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 2417 - protein, 574 aa, respiratory syncytial virus
MELLILKANAITTILTAVTFCFASGQNITEEFYQSTCSAVSKGYLSALRTGWYTSVITIELSNIKKNKCNGTDAKVKLIKQELDKYKNAVTELQLLMQSTQATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 2418 - protein, 574 aa, respiratory syncytial virus
MELLIHRSSAIFLTLAVNALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNRLLPIVNQQSCRISNIETVIEFQQMNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLLLIAIGLLLYCKAKNTPVTLSKDQLSGINNIAFSK

SEQ ID NO: 2419 - DNA, 18 bp, Artificial
  Primer
cttagcagaaaaccgtga

SEQ ID NO: 2420 - DNA, 18 bp, Artificial
  Primer
tgggttgatttgggattg

SEQ ID NO: 2421 - DNA, 19 bp, Artificial
  Primer
ggactgatagaggatggta

SEQ ID NO: 2422 - DNA, 18 bp, Artificial
  Primer
gctgacttcacttggtaa

SEQ ID NO: 2423 - protein, 247 aa, Artificial
  Nanobody sequence
EVQLVESGGGLVQPGGSLRLSCTGSGFTFSSYWMDWVRQTPGKDLEYVSGISPSGSNTDYADSVKGRFTISRDNAKNTLYLQMNSLKPEDTALYYCRRSLTLTDSPDLRSQGTQVTVSSGGGSGGGGSEVQLVESGGGLVQPGGSLRLSCTGSGFTFSSYWMDWVRQTPGKDLEYVSGISPSGSNTDYADSVKGRFTISRDNAKNTLYLQMNSLKPEDTALYYCRRSLTLTDSPDLRSQGTQVTVSS

SEQ ID NO: 2424 - protein, 253 aa, Artificial
  Nanobody sequence
EVQLVESGGGLVQPGGSLRLSCTGSGFTFSSYWMDWVRQTPGKDLEYVSGISPSGSNTDYADSVKGRFTISRDNAKNTLYLQMNSLKPEDTALYYCRRSLTLTDSPDLRSQGTQVTVSSGGGGSGGGGSGGGGSEVQLVESGGGLVQPGGSLRLSCTGSGFTFSSYWMDWVRQTPGKDLEYVSGISPSGSNTDYADSVKGRFTISRDNAKNTLYLQMNSLKPEDTALYYCRRSLTLTDSPDLRSQGTQVTVSS

SEQ ID NO: 2425 - protein, 377 aa, Artificial
  Nanobody sequence
EVQLVESGGGLVQPGGSLRLSCTGSGFTFSSYWMDWVRQTPGKDLEYVSGISPSGSNTDYADSVKGRFTISRDNAKNTLYLQMNSLKPEDTALYYCRRSLTLTDSPDLRSQGTQVTVSSGGGGSGGGGSEVQLVESGGGLVQPGGSLRLSCTGSGFTFSSYWMDWVRQTPGKDLEYVSGISPSGSNTDYADSVKGRFTISRDNAKNTLYLQMNSLKPEDTALYYCRRSLTLTDSPDLRSQGTQVTVSSGGGGSGGGGSEVQLVESGGGLVQPGGSLRLSCTGSGFTFSSYWMDWVRQTPGKDLEYVSGISPSGSNTDYADSVKGRFTISRDNAKNTLYLQMNSLKPEDTALYYCRRSLTLTDSPDLRSQGTQVTVSS

SEQ ID NO: 2426 - protein, 397 aa, Artificial
  Nanobody sequence
EVQLVESGGGLVQPGGSLRLSCTGSGFTFSSYWMDWVRQTPGKDLEYVSGISPSGSNTDYADSVKGRFTISRDNAKNTLYLQMNSLKPEDTALYYCRRSLTLTDSPDLRSQGTQVTVSSGGGGSGGGGSGGGGSGGGGSEVQLVESGGGLVQPGGSLRLSCTGSGFTFSSYWMDWVRQTPGKDLEYVSGISPSGSNTDYADSVKGRFTISRDNAKNTLYLQMNSLKPEDTALYYCRRSLTLTDSPDLRSQGTQVTVSSGGGGSGGGGSGGGGSGGGGSEVQLVESGGGLVQPGGSLRLSCTGSGFTFSSYWMDWVRQTPGKDLEYVSGISPSGSNTDYADSVKGRFTISRDNAKNTLYLQMNSLKPEDTALYYCRRSLTLTDSPDLRSQGTQVTVSS

SEQ ID NO: 2427 - protein, 263 aa, Artificial
  Nanobody sequence
EVQLVESGGGLVQAGGSLRLSCAASGRTLSSYRMGWFRQAPGKEREFISTISWNGRSTYYADSVKGRFIFSEDNAKNTVYLQMNSLKPEDTAVYYCAAALIGGYYSDVDAWSYWGPGTQVTVSSGGGGSGGGGSGGGGSEVQLVESGGGLVQAGGSLRLSCAASGRTLSSYRMGWFRQAPGKEREFISTISWNGRSTYYADSVKGRFIFSEDNAKNTVYLQMNSLKPEDTAVYYCAAALIGGYYSDVDAWSYWGPGTQVTVSS

SEQ ID NO: 2428 - protein, 257 aa, Artificial
  Nanobody sequence
EVQLVESGGGLVQPGGSLRLSCAASGFTFSSYAMGWVRRAPGEGLEWVSSISSGGALPTYADSVKGRFTISRDNVKNTLYLQMNSLKPEDTAVYSCEKYAGSMWTSERDAWGQGTQVTVSSGGGGSGGGGSGGGGSEVQLVESGGGLVQPGGSLRLSCAASGFTFSSYAMGWVRRAPGEGLEWVSSISSGGALPTYADSVKGRFTISRDNVKNTLYLQMNSLKPEDTAVYSCEKYAGSMWTSERDAWGQGTQVTVSS

SEQ ID NO: 2429 - protein, 243 aa, Artificial
  Nanobody sequence
EVQLVESGGGLVQPGGSLRLSCTGSGFTFSSYWMDWVRQTPGKDLEYVSGISPSGGNTDYADSVKGRFTISRDNAKNTLYLQMNSLQPEDTALYYCRRSLTLTDSPDLRSQGTQVTVSSGGGGSEVQLVESGGGLVQPGGSLRLSCTGSGFTFSSYWMDWVRQTPGKDLEYVSGISPSGGNTDYADSVKGRFTISRDNAKNTLYLQMNSLQPEDTALYYCRRSLTLTDSPDLRSQGTQVTVSS

SEQ ID NO: 2430 - protein, 263 aa, Artificial
  Nanobody sequence
EVQLVESGGGLVQPGGSLRLSCTGSGFTFSSYWMDWVRQTPGKDLEYVSGISPSGGNTDYADSVKGRFTISRDNAKNTLYLQMNSLQPEDTALYYCRRSLTLTDSPDLRSQGTQVTVSSGGGGSGGGGSGGGGSGGGGSGGGGSEVQLVESGGGLVQPGGSLRLSCTGSGFTFSSYWMDWVRQTPGKDLEYVSGISPSGGNTDYADSVKGRFTISRDNAKNTLYLQMNSLQPEDTALYYCRRSLTLTDSPDLRSQGTQVTVSS

SEQ ID NO: 2431 - protein, 120 aa, Artificial
  Nanobody sequence
EVQLVESGGDLVQPGGSLRLSCAASGFTFRGYWMTWVRQAPGKGLEWVSSINNVGEETYYVDSVKGRFTISRDNAKNTLYLQMNSLKSEDTAVYYCVKDWESSYAGYSPNSQGTQVTVSS

SEQ ID NO: 2432 - protein, 120 aa, Artificial; identical to SEQ ID NO: 128
  Nanobody sequence

SEQ ID NO: 2433 - protein, 120 aa, Artificial
  Nanobody sequence
EVQLVESGGDLVQPGGSLRLSCAASGFTFSGYWMTWVRQAPGKGLEWVTSINNIGEETYYVDSVKGRFTISRDNAKNTLYLQMNSLKSEDTAVYYCVKDWASTYAGYRPNSQGTQVTVSS

SEQ ID NO: 2434 - protein, 124 aa, Artificial
  Nanobody sequence
EVQLVESGGGVVQAGGSLRLSCAASGLTFDIYSMGWFRQQPGKEREFVASIGRSGNSTNYASSVKDRFTISRDNAKKLVYLEMNSLTVEDAAVYVCAAKDGPLITHYSTTSMYWGQGTQVTVSS

SEQ ID NO: 2435 - protein, 120 aa, Artificial; identical to SEQ ID NO: 130
  Nanobody sequence

SEQ ID NO: 2436 - protein, 127 aa, Artificial
  Nanobody sequence
EVQLMESGGGLVQAGGSLRLSCVAPGRIFSSYTMGWFRQAPGKERDFVAAISTVGSTYYSDSVKGRCTISRDNANNTVALELNSLKPDDTAVYYCAABSHTYGSTYAATIDYEYDYWGQGTQVTVSS

SEQ ID NO: 2437 - protein, 124 aa, Artificial
  Nanobody sequence
EVQLVESGGGLVQAGDSLTLSCIDSGRTFSDYPIGWFRQAPGKEREFVAAIYAIGGDVYYADSVKGRFTISRDNAKNTVYLQMSSLKPEDTAIYSCAVASGGGSIRSARRYDYWGQGTQVTVSS

SEQ ID NO: 2438 - protein, 129 aa, Artificial
  Nanobody sequence
EVQLVESGGGLVQAGDSLRLSCIDSGRTFSDYPIGWFRQAPGKEREFVAAIYPTDDNPTGPNAYYADSVKGRFTISRDNAKNTVYLQMSSLKPEDTAIYSCAVASGGGSIISARRYDYWGQGTQVTVSS

SEQ ID NO: 2439 - protein, 121 aa, Artificial
  Nanobody sequence
EVQLVESGGGLVQPGGSLRLSCAASGFTFSSYAMGWVRRAPGEGLEWVSSISSGGALPTYADSVKGRFTISRDNVKNTLYLQMNSLKPEDTAVYSCEKYAGSMWTSERDAWGQGTQVTVSS

SEQ ID NO: 2440 - protein, 115 aa, Artificial; identical to SEQ ID NO: 140
  Nanobody sequence

SEQ ID NO: 2441 - protein, 126 aa, Artificial
  Nanobody sequence
EVQLVESGGGWVQAGDSLRLSCAASGRTLSSYAMAWFRQAPGKERDFVTGITWNGGSTYYADSVKGRFTISRDNAKNTVYLQMNSLKPEDTAVYYCAABQNTYGYMDRSDYEYDYWGQGTQVTVSS

SEQ ID NO: 2442 - protein, 120 aa, Artificial
  Nanobody sequence
EVQLVESGGDLVQPGGSLRLSCAASGFTFRGYWMTWVRQAPGKGLEWVSSINNIGDEPYYVDSVKGRFTISRDNAKNTLYLQMNSLKSEDTAVYYCVKDWASDYAGYSPNSQGTQVTVSS

SEQ ID NO: 2443 - protein, 119 aa, Artificial
  Nanobody sequence
EVQLVESGGGLVQPGGSLRLSCTASGFTFSSYWMDWVRQTPGKGLEYVSGISPSGGNTDYADSVKGRFTISRDNAKNTLYLQMNSLKPEDTALYYCRRSLTFTDTPDLRSQGTQVTVSS

SEQ ID NO: 2444 - protein, 126 aa, Artificial
  Nanobody sequence
EVQLVESGGGWVQAGDSLRLSCAASGRTLSSYAMAWFRQAPGKERDFVTGITWNGGSTYYADSVKGRFTISRDNAKNTVYLQMNSLKPEDTAVYYCAADQNTYGYMDRSDYEYDYWGQGTQVTVSS

SEQ ID NO: 2445 - protein, 119 aa, Artificial
  Nanobody sequence
EVQLVESGGGLVQPGGSLRLSCTGSGFTFSSYWMDWVRQTPGKDLEYVSGISPSGGNTDYADSVKGRFTISRDNAKNTLYLQMNSLQPEDTALYYCRRSLTLTDSPDLRSQGTQVTVSS

SEQ ID NO: 2446 - protein, 124 aa, Artificial; identical to SEQ ID NO: 126
  Nanobody sequence

SEQ ID NO: 2447 - protein, 113 aa, Artificial
  Nanobody sequence
EVQLVESGGGLVQAGGSLRLSCAASVSAFSEYAMGWYRQAPGKQREFVATINSLGGTSYADSVKGRFTISRDNAKNTVYLQMNSLKPEDTAVYYCTLYRANLWGQGTQVTVSS

SEQ ID NO: 2448 - protein, 119 aa, Artificial
  Nanobody sequence
KVQLVESGGGLVQPGGSLRLSCAASGSIFSINAMGWYRQAPGKQRELVAHIASSGSTIYADSVKGRFTISRDNAKNTVYLQMNSLKPEDTAVYYCNTRGPAAHEVRDYWGQGTQVTVSS

SEQ ID NO: 2449 - protein, 30 aa, Artificial; identical to SEQ ID NO: 410
  Framework sequence

SEQ ID NO: 2450 - protein, 30 aa, Artificial; identical to SEQ ID NO: 410
  Framework sequence

SEQ ID NO: 2451 - protein, 30 aa, Artificial; identical to SEQ ID NO: 438
  Framework sequence

SEQ ID NO: 2452 - protein, 30 aa, Artificial
  Framework sequence
EVQLVESGGGVVQAGGSLRLSCAASGLTFD

SEQ ID NO: 2453 - protein, 30 aa, Artificial; identical to SEQ ID NO: 412
  Framework sequence

SEQ ID NO: 2454 - protein, 30 aa, Artificial
  Framework sequence
EVQLMESGGGLVQAGGSLRLSCVAPGRIFS

SEQ ID NO: 2455 - protein, 30 aa, Artificial
  Framework sequence
EVQLVESGGGLVQAGDSLTLSCIDSGRTFS

SEQ ID NO: 2456 - protein, 30 aa, Artificial; identical to SEQ ID NO: 408
  Framework sequence

SEQ ID NO: 2457 - protein, 30 aa, Artificial; identical to SEQ ID NO: 414
  Framework sequence

SEQ ID NO: 2458 - protein, 30 aa, Artificial; identical to SEQ ID NO: 422
  Framework sequence

SEQ ID NO: 2459 - protein, 30 aa, Artificial
  Framework sequence
EVQLVESGGGWVQAGDSLRLSCAASGRTLS

SEQ ID NO: 2460 - protein, 30 aa, Artificial; identical to SEQ ID NO: 410
  Framework sequence

SEQ ID NO: 2461 - protein, 30 aa, Artificial
  Framework sequence
EVQLVESGGGLVQPGGSLRLSCTASGFTFS

SEQ ID NO: 2462 - protein, 30 aa, Artificial; identical to SEQ ID NO: 2459
  Framework sequence

SEQ ID NO: 2463 - protein, 30 aa, Artificial; identical to SEQ ID NO: 420
  Framework sequence

SEQ ID NO: 2464 - protein, 30 aa, Artificial; identical to SEQ ID NO: 408
  Framework sequence

SEQ ID NO: 2465 - protein, 30 aa, Artificial
  Framework sequence
EVQLVESGGGLVQAGGSLRLSCAASVSAFS

SEQ ID NO: 2466 - protein, 30 aa, Artificial
  Framework sequence
KVQLVESGGGLVQPGGSLRLSCAASGSIFS

SEQ ID NO: 2467 - protein, 5 aa, Artificial
  CDR1 sequence
GYWMT

SEQ ID NO: 2468 - protein, 5 aa, Artificial
  CDR1 sequence
GYWMT

SEQ ID NO: 2469 - protein, 5 aa, Artificial
  CDR1 sequence
GYWMT

SEQ ID NO: 2470 - protein, 5 aa, Artificial
  CDR1 sequence
IYSMG

SEQ ID NO: 2471 - protein, 5 aa, Artificial
  CDR1 sequence
GYWMS

SEQ ID NO: 2472 - protein, 5 aa, Artificial
  CDR1 sequence
SYTMG

SEQ ID NO: 2473 - protein, 5 aa, Artificial
  CDR1 sequence
DYPIG

SEQ ID NO: 2474 - protein, 5 aa, Artificial
  CDR1 sequence
DYPIG

SEQ ID NO: 2475 - protein, 5 aa, Artificial
  CDR1 sequence
SYAMG

SEQ ID NO: 2476 - protein, 5 aa, Artificial
  CDR1 sequence
STAMG

SEQ ID NO: 2477 - protein, 5 aa, Artificial
  CDR1 sequence
SYAMA

SEQ ID NO: 2478 - protein, 5 aa, Artificial
  CDR1 sequence
GYWMT

SEQ ID NO: 2479 - protein, 5 aa, Artificial
  CDR1 sequence
SYWMD

SEQ ID NO: 2480 - protein, 5 aa, Artificial
  CDR1 sequence
SYAMA

SEQ ID NO: 2481 - protein, 5 aa, Artificial
  CDR1 sequence
SYWMD

SEQ ID NO: 2482 - protein, 5 aa, Artificial
  CDR1 sequence
DYPIG

SEQ ID NO: 2483 - protein, 5 aa, Artificial
  CDR1 sequence
EYAMG

SEQ ID NO: 2484 - protein, 5 aa, Artificial
  CDR1 sequence
INAMG

SEQ ID NO: 2485 - protein, 14 aa, Artificial
  Framework sequence
WVRQAPGKGLEWVS

SEQ ID NO: 2486 - protein, 14 aa, Artificial
  Framework sequence
WVRQAPGKGLEWVS

SEQ ID NO: 2487 - protein, 14 aa, Artificial
  Framework sequence
WVRQAPGKGLEWVT

SEQ ID NO: 2488 - protein, 14 aa, Artificial
  Framework sequence
WFRQQPGKEREFVA

SEQ ID NO: 2489 - protein, 14 aa, Artificial
  Framework sequence
WVRQAPGKGLEWVS

SEQ ID NO: 2490 - protein, 14 aa, Artificial
  Framework sequence
WFRQAPGKERDFVA

SEQ ID NO: 2491 - protein, 14 aa, Artificial
  Framework sequence
WFRQAPGKEREFVA

SEQ ID NO: 2492 - protein, 14 aa, Artificial
  Framework sequence
WFRQAPGKEREFVA

SEQ ID NO: 2493 - protein, 14 aa, Artificial
  Framework sequence
WVRRAPGEGLEWVS

SEQ ID NO: 2494 - protein, 14 aa, Artificial
  Framework sequence
WSRQAPGKQREWVA

SEQ ID NO: 2495 - protein, 14 aa, Artificial
  Framework sequence
WFRQAPGKERDFVT

SEQ ID NO: 2496 - protein, 14 aa, Artificial
  Framework sequence
WVRQAPGKGLEWVS

SEQ ID NO: 2497 - protein, 14 aa, Artificial
  Framework sequence
WVRQTPGKGLEYVS

SEQ ID NO: 2498 - protein, 14 aa, Artificial
  Framework sequence
WFRQAPGKERDFVT

SEQ ID NO: 2499 - protein, 14 aa, Artificial
  Framework sequence
WVRQTPGKDLEYVS

SEQ ID NO: 2500 - protein, 14 aa, Artificial
  Framework sequence
WFRQAPGKEREFVA

SEQ ID NO: 2501 - protein, 14 aa, Artificial
  Framework sequence
WYRQAPGKQREFVA

SEQ ID NO: 2502 - protein, 14 aa, Artificial
  Framework sequence
WYRQAPGKQRELVA

SEQ ID NO: 2503 - protein, 17 aa, Artificial
  CDR2 sequence
SINNVGEETYYVDSVKG

SEQ ID NO: 2504 - protein, 17 aa, Artificial
  CDR2 sequence
SINNIGEEAYYVDSVKG

SEQ ID NO: 2505 - protein, 17 aa, Artificial
  CDR2 sequence
SINNIGEETYYVDSVKG

SEQ ID NO: 2506 - protein, 17 aa, Artificial
  CDR2 sequence
SIGRSGNSTNYASSVKD

SEQ ID NO: 2507 - protein, 17 aa, Artificial
  CDR2 sequence
AINNVGDEVYYADSVKG

SEQ ID NO: 2508 - protein, 16 aa, Artificial
  CDR2 sequence
AISTVGSTYYSDSVKG

SEQ ID NO: 2509 - protein, 17 aa, Artificial
  CDR2 sequence
AIYAIGGDVYYADSVKG

SEQ ID NO: 2510 - protein, 22 aa, Artificial
  CDR2 sequence
AIYPTDDNPTGPNAYYADSVKG

SEQ ID NO: 2511 - protein, 17 aa, Artificial
  CDR2 sequence
SISSGGALPTYADSVKG

SEQ ID NO: 2512 - protein, 16 aa, Artificial
  CDR2 sequence
SISSAGTIRYVDSVKG

SEQ ID NO: 2513 - protein, 17 aa, Artificial
  CDR2 sequence
GITWNGGSTYYADSVKG

SEQ ID NO: 2514 - protein, 17 aa, Artificial
  CDR2 sequence
SINNIGDEPYYVDSVKG

SEQ ID NO: 2515 - protein, 17 aa, Artificial
  CDR2 sequence
GISPSGGNTDYADSVKG

SEQ ID NO: 2516 - protein, 17 aa, Artificial
  CDR2 sequence
GITWNGGSTYYADSVKG

SEQ ID NO: 2517 - protein, 17 aa, Artificial
  CDR2 sequence
GISPSGGNTDYADSVKG

SEQ ID NO: 2518 - protein, 17 aa, Artificial
  CDR2 sequence
AIYAIGGDVYYADSVKG

SEQ ID NO: 2519 - protein, 16 aa, Artificial
  CDR2 sequence
TINSLGGTSYADSVKG

SEQ ID NO: 2520 - protein, 16 aa, Artificial
  CDR2 sequence
HIASSGSTIYADSVKG

SEQ ID NO: 2521 - protein, 32 aa, Artificial; identical to SEQ ID NO: 1538
  Framework sequence

SEQ ID NO: 2522 - protein, 32 aa, Artificial; identical to SEQ ID NO: 1538
  Framework sequence

SEQ ID NO: 2523 - protein, 32 aa, Artificial; identical to SEQ ID NO: 1538
  Framework sequence

SEQ ID NO: 2524 - protein, 32 aa, Artificial
  Framework sequence
RFTISRDNAKKLVYLEMNSLTVEDAAVYVCAA

SEQ ID NO: 2525 - protein, 32 aa, Artificial; identical to SEQ ID NO: 1540
  Framework sequence

SEQ ID NO: 2526 - protein, 32 aa, Artificial
  Framework sequence
RCTISRDNANNTVALELNSLKPDDTAVYYCAA

SEQ ID NO: 2527 - protein, 32 aa, Artificial; identical to SEQ ID NO: 1536
  Framework sequence

SEQ ID NO: 2528 - protein, 32 aa, Artificial; identical to SEQ ID NO: 1536
  Framework sequence

SEQ ID NO: 2529 - protein, 32 aa, Artificial
  Framework sequence
RFTISRDNVKNTLYLQMNSLKPEDTAVYSCEK

SEQ ID NO: 2530 - protein, 32 aa, Artificial; identical to SEQ ID NO: 1550
  Framework sequence

SEQ ID NO: 2531 - protein, 32 aa, Artificial; identical to SEQ ID NO: 112
  Framework sequence

SEQ ID NO: 2532 - protein, 32 aa, Artificial; identical to SEQ ID NO: 1538
  Framework sequence

SEQ ID NO: 2533 - protein, 32 aa, Artificial; identical to SEQ ID NO: 1548
  Framework sequence

SEQ ID NO: 2534 - protein, 32 aa, Artificial; identical to SEQ ID NO: 112
  Framework sequence

SEQ ID NO: 2535 - protein, 32 aa, Artificial
  Framework sequence
RFTISRDNAKNTLYLQMNSLQPEDTALYYCRR

SEQ ID NO: 2536 - protein, 32 aa, Artificial; identical to SEQ ID NO: 1536
  Framework sequence

SEQ ID NO: 2537 - protein, 32 aa, Artificial
  Framework sequence
RFTISRDNAKNTVYLQMNSLKPEDTAVYYCTL

SEQ ID NO: 2538 - protein, 32 aa, Artificial; identical to SEQ ID NO: 1635
  Framework sequence

SEQ ID NO: 2539 - protein, 11 aa, Artificial
  CDR3 sequence
DWESSYAGYSP

SEQ ID NO: 2540 - protein, 11 aa, Artificial
  CDR3 sequence
DWASDYAGYSP

SEQ ID NO: 2541 - protein, 11 aa, Artificial
  CDR3 sequence
DWASTYAGYRP

SEQ ID NO: 2542 - protein, 15 aa, Artificial
  CDR3 sequence
KDGPLITHYSTTSMY

SEQ ID NO: 2543 - protein, 11 aa, Artificial
  CDR3 sequence
DWYNDPNKNEY

SEQ ID NO: 2544 - protein, 19 aa, Artificial
  CDR3 sequence
BSHTYGSTYAATIDYEYDY

SEQ ID NO: 2545 - protein, 15 aa, Artificial
  CDR3 sequence
ASGGGSIRSARRYDY

SEQ ID NO: 2546 - protein, 15 aa, Artificial
  CDR3 sequence
ASGGGSIISARRYDY

SEQ ID NO: 2547 - protein, 12 aa, Artificial
  CDR3 sequence
YAGSMWTSERDA

SEQ ID NO: 2548 - protein, 7 aa, Artificial
  CDR3 sequence
VGNFTTY

SEQ ID NO: 2549 - protein, 17 aa, Artificial
  CDR3 sequence
BQNTYGYMDRSDYEYDY

SEQ ID NO: 2550 - protein, 11 aa, Artificial
  CDR3 sequence
DWASDYAGYSP

SEQ ID NO: 2551 - protein, 10 aa, Artificial
  CDR3 sequence
SLTFTDTPDL

SEQ ID NO: 2552 - protein, 17 aa, Artificial
  CDR3 sequence
DQNTYGYMDRSDYEYDY

SEQ ID NO: 2553 - protein, 10 aa, Artificial
  CDR3 sequence
SLTLTDSPDL

SEQ ID NO: 2554 - protein, 15 aa, Artificial
  CDR3 sequence
ASGGGSIRSARRYDY

SEQ ID NO: 2555 - protein, 5 aa, Artificial
  CDR3 sequence
YRANL

SEQ ID NO: 2556 - protein, 11 aa, Artificial
  CDR3 sequence
RGPAAHEVRDY

SEQ ID NO: 2557 - protein, 11 aa, Artificial
  Framework sequence
NSQGTQVTVSS

SEQ ID NO: 2558 - protein, 11 aa, Artificial
  Framework sequence
NSQGTQVTVSS

SEQ ID NO: 2559 - protein, 11 aa, Artificial
  Framework sequence
NSQGTQVTVSS

SEQ ID NO: 2560 - protein, 11 aa, Artificial
  Framework sequence
WGQGTQVTVSS

SEQ ID NO: 2561 - protein, 11 aa, Artificial
  Framework sequence
KGQGTQVTVSS

SEQ ID NO: 2562 - protein, 11 aa, Artificial
  Framework sequence
WGQGTQVTVSS

SEQ ID NO: 2563 - protein, 11 aa, Artificial
  Framework sequence
WGQGTQVTVSS

SEQ ID NO: 2564 - protein, 11 aa, Artificial
  Framework sequence
WGQGTQVTVSS

SEQ ID NO: 2565 - protein, 11 aa, Artificial
  Framework sequence
WGQGTQVTVSS

SEQ ID NO: 2566 - protein, 11 aa, Artificial
  Framework sequence
WGRGTQVTVSS

SEQ ID NO: 2567 - protein, 11 aa, Artificial
  Framework sequence
WGQGTQVTVSS

SEQ ID NO: 2568 - protein, 11 aa, Artificial
  Framework sequence
NSQGTQVTVSS

SEQ ID NO: 2569 - protein, 11 aa, Artificial
  Framework sequence
RSQGTQVTVSS

SEQ ID NO: 2570 - protein, 11 aa, Artificial
  Framework sequence
WGQGTQVTVSS

SEQ ID NO: 2571 - protein, 11 aa, Artificial
  Framework sequence
RSQGTQVTVSS

SEQ ID NO: 2572 - protein, 11 aa, Artificial
  Framework sequence
WGRGTQVTVSS

SEQ ID NO: 2573 - protein, 11 aa, Artificial
  Framework sequence
WGQGTQVTVSS

SEQ ID NO: 2574 - protein, 125 aa, Artificial
  Nanobody sequence
EVQLVESGGGLVQAGGSLRLSCAASRSIFSFNTMGWYRQAPGKQRELVADITSGGSTVYADSVKGRFTISRDDKNTVYLQMNSLKPEDTAVYSCNAEGLIIATMNGGVNYGMDYWGKGTLVTVSS

SEQ ID NO: 2575 - protein, 119 aa, Artificial
  Nanobody sequence
EVQLVESGGGLVQPGGSLRLSCAASGSIFSINAMGWHRQALGKQRELVAQSSSGGSTYYADSAKGRFTISRDNAKNMVYLQMNSLKPEDTAVYYCNVRTPEVHTIRDYWGQGTQVTVSS

SEQ ID NO: 2576 - protein, 128 aa, Artificial; identical to SEQ ID NO: 402
  Nanobody sequence

SEQ ID NO: 2577 - protein, 127 aa, Artificial
  Nanobody sequence
EVQLVESGGGLVQAGGSLRLSCAASGRTFSSFAMGWFRQAPGKEREFVAAISWSGGSTYYADSVKGRFTISGDNAKNTMYLQMNSLKPEDTAVYYCAADSEILNSGAYYYPWAYVYWGQGTQVTVSS

SEQ ID NO: 2578 - protein, 126 aa, Artificial
  Nanobody sequence
EVQLVESGGGSVQAGGSLRLSCAASGGSFNRFGMGWFRRAPGKERDFVAAINLSGDTTYYVDSVQGRFTISRDNANNIMYLQMNLLKPEDTADYYCAADPDPITAWKQSGAGMDYWGKGTQVTVSS

SEQ ID NO: 2579 - protein, 126 aa, Artificial
  Nanobody sequence
EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSS

SEQ ID NO: 2580 - protein, 128 aa, Artificial; identical to SEQ ID NO: 351
  Nanobody sequence

SEQ ID NO: 2581 - protein, 128 aa, Artificial; identical to SEQ ID NO: 340
  Nanobody sequence

SEQ ID NO: 2582 - protein, 30 aa, Artificial
  Framework sequence
EVQLVESGGGLVQAGGSLRLSCAASRSIFS

SEQ ID NO: 2583 - protein, 30 aa, Artificial; identical to SEQ ID NO: 496
  Framework sequence

SEQ ID NO: 2584 - protein, 30 aa, Artificial; identical to SEQ ID NO: 445
  Framework sequence

SEQ ID NO: 2585 - protein, 30 aa, Artificial; identical to SEQ ID NO: 428
  Framework sequence

SEQ ID NO: 2586 - protein, 30 aa, Artificial
  Framework sequence
EVQLVESGGGSVQAGGSLRLSCAASGGSFN

SEQ ID NO: 2587 - protein, 30 aa, Artificial; identical to SEQ ID NO: 654
  Framework sequence

SEQ ID NO: 2588 - protein, 30 aa, Artificial; identical to SEQ ID NO: 428
  Framework sequence

SEQ ID NO: 2589 - protein, 30 aa, Artificial; identical to SEQ ID NO: 622
  Framework sequence

SEQ ID NO: 2590 - protein, 5 aa, Artificial
  CDR1 sequence
FNTMG

SEQ ID NO: 2591 - protein, 5 aa, Artificial
  CDR1 sequence
INAMG

SEQ ID NO: 2592 - protein, 5 aa, Artificial
  CDR1 sequence
SYDMG

SEQ ID NO: 2593 - protein, 5 aa, Artificial
  CDR1 sequence
SFAMG

SEQ ID NO: 2594 - protein, 5 aa, Artificial
  CDR1 sequence
RFGMG

SEQ ID NO: 2595 - protein, 5 aa, Artificial
  CDR1 sequence
NYVLG

SEQ ID NO: 2596 - protein, 5 aa, Artificial
  CDR1 sequence
RYIMG

SEQ ID NO: 2597 - protein, 5 aa, Artificial
  CDR1 sequence
RYAMG

SEQ ID NO: 2598 - protein, 14 aa, Artificial
  Framework sequence
WYRQAPGKQRELVA

SEQ ID NO: 2599 - protein, 14 aa, Artificial
  Framework sequence
WHRQALGKQRELVA

SEQ ID NO: 2600 - protein, 14 aa, Artificial
  Framework sequence
WFRQAPGKEREFVA

SEQ ID NO: 2601 - protein, 14 aa, Artificial
  Framework sequence
WFRQAPGKEREFVA

SEQ ID NO: 2602 - protein, 14 aa, Artificial
  Framework sequence
WFRRAPGKERDFVA

SEQ ID NO: 2603 - protein, 14 aa, Artificial
  Framework sequence
WFRQAPGKEREFVA

SEQ ID NO: 2604 - protein, 14 aa, Artificial
  Framework sequence
WFRQAPGKEREFVG

SEQ ID NO: 2605 - protein, 14 aa, Artificial
  Framework sequence
WFRQAPGKERESVA

SEQ ID NO: 2606 - protein, 16 aa, Artificial
  CDR2 sequence
DITSGGSTVYADSVKG

SEQ ID NO: 2607 - protein, 16 aa, Artificial
  CDR2 sequence
QSSSGGSTYYADSAKG

SEQ ID NO: 2608 - protein, 18 aa, Artificial
  CDR2 sequence
AVTRWSGARGVYADSVKG

SEQ ID NO: 2609 - protein, 17 aa, Artificial
  CDR2 sequence
AISWSGGSTYYADSVKG

SEQ ID NO: 2610 - protein, 17 aa, Artificial
  CDR2 sequence
AINLSGDTTYYVDSVQG

SEQ ID NO: 2611 - protein, 17 aa, Artificial
  CDR2 sequence
AINWRGDITIGPPNVEG

SEQ ID NO: 2612 - protein, 17 aa, Artificial
  CDR2 sequence
AISRSGDITSFADFVKG

SEQ ID NO: 2613 - protein, 17 aa, Artificial
  CDR2 sequence
AISSSGDNIYYADSVKG

SEQ ID NO: 2614 - protein, 31 aa, Artificial
  Framework sequence
RFTISRDDKNTVYLQMNSLKPEDTAVYSCNA

SEQ ID NO: 2615 - protein, 32 aa, Artificial
  Framework sequence
RFTISRDNAKNMVYLQMNSLKPEDTAVYYCNV

SEQ ID NO: 2616 - protein, 32 aa, Artificial; identical to SEQ ID NO: 1812
  Framework sequence

SEQ ID NO: 2617 - protein, 32 aa, Artificial
  Framework sequence
RFTISGDNAKNTMYLQMNSLKPEDTAVYYCAA

SEQ ID NO: 2618 - protein, 32 aa, Artificial
  Framework sequence
RFTISRDNANNIMYLQMNLLKPEDTADYYCAA

SEQ ID NO: 2619 - protein, 32 aa, Artificial
  Framework sequence
RFTISRDNAKNTGYLQMNSLAPDDTAVYYCGA

SEQ ID NO: 2620 - protein, 32 aa, Artificial; identical to SEQ ID NO: 1761
  Framework sequence

SEQ ID NO: 2621 - protein, 32 aa, Artificial
  Framework sequence
QFTMSRDNAKSSVYLQMINLKPEDTAVYYCAA

SEQ ID NO: 2622 - protein, 18 aa, Artificial
  CDR3 sequence
EGLIIATMNGGVNYGMDY

SEQ ID NO: 2623 - protein, 11 aa, Artificial
  CDR3 sequence
RTPEVHTIRDY

SEQ ID NO: 2624 - protein, 18 aa, Artificial
  CDR3 sequence
DSTNRNSGAVYYTWAYDY

SEQ ID NO: 2625 - protein, 18 aa, Artificial
  CDR3 sequence
DSEILNSGAYYYPWAYVY

SEQ ID NO: 2626 - protein, 17 aa, Artificial
  CDR3 sequence
DPDPITAWKQSGAGMDY

SEQ ID NO: 2627 - protein, 17 aa, Artificial
  CDR3 sequence
GTPLNPGAYIYDWSYDY

SEQ ID NO: 2628 - protein, 19 aa, Artificial
  CDR3 sequence
NSDTYYIYSDIVVPERYDY

SEQ ID NO: 2629 - protein, 19 aa, Artificial
  CDR3 sequence
ATSPLFVASDYFDASRYDY

SEQ ID NO: 2630 - protein, 11 aa, Artificial
  Framework sequence
WGKGTLVTVSS

SEQ ID NO: 2631 - protein, 11 aa, Artificial
  Framework sequence
WGQGTQVTVSS

SEQ ID NO: 2632 - protein, 11 aa, Artificial
  Framework sequence
WGQGTQVTVSS

SEQ ID NO: 2633 - protein, 11 aa, Artificial
  Framework sequence
WGQGTQVTVSS

SEQ ID NO: 2634 - protein, 11 aa, Artificial
  Framework sequence
WGKGTQVTVSS

SEQ ID NO: 2635 - protein, 11 aa, Artificial
  Framework sequence
WGRGTQVTVSS

SEQ ID NO: 2636 - protein, 11 aa, Artificial
  Framework sequence
WGQGTQVTVSS

SEQ ID NO: 2637 - protein, 11 aa, Artificial
  Framework sequence
WGQGTQVTVSS

SEQ ID NO: 2638 - protein, 9 aa, Artificial
  5' consensus sequence
GCCGCCACC

SEQ ID NO: 2639 - protein, 9 aa, Artificial
  Linker sequence
GGGGSGGGS

SEQ ID NO: 2640 - protein, 62 aa, Artificial
  Linker sequence
ELKTPLGDTTHTCPRCPEPKSCDTPPPCPRCPEPKSCDTPPPCPRCPEPKSCDTPPPCPRCP

SEQ ID NO: 2641 - DNA, 1455 bp, Artificial
  Nanobody sequence
gaggtgcaattggtagagagtggcggaggtctagtgcaagcgggaggctcgctgagcattagctgcgcagcatcgggcggatcgttgtctaactacgttctgggctggtttaggcaagcgccagggaaagagagagagttcgtcgctgcgataaactggcgcggtgacataacgatcggacctccaaatgtagaaggaagattcaccattagcagagacaatgcaaagaacacgggttacctacagatgaactcactggctccggacgacactgcagtgtactactgtggtgcagggactcccctaaacccaggggcatatatttatgactggtcatacgattattggggcagaggaacgcaagtgaccgtcagcagtgaacccaaaagctgtgacaagacccatacatgccctccctgtccagcgcccgaactgcttggaggaccaagtgttttcttattcccgccaaagcccaaggacacgttgatgattagcaggaccccggaagtgacatgcgtagttgtagatgtaagccacgaagatccggaggtcaagttcaattggtatgttgatggggtggaagtgcataacgctaaaactaaaccacgtgaggaacagtacaactctacttacagggtagtgtcggtattgacagttctgcatcaagattggctaaacggcaaagaatataagtgtaaagtaagtaataaagcgctccccgcacccattgaaaagaccatttcgaaggcaaagggtcagccacgcgagccgcaggtgtatacactgcccccttccagggacgagcttacgaagaaccaggttagcttgacttgccttgtaaagggattctaccccagtgacatagcagtagaatgggaatcgaacgggcaacccgaaaacaattacaagacaaccccaccggtcttggactctgatggctctttcttcttgtactccaagttaaccgtagacaaatcgaggtggcagcaaggaaacgttttctcgtgctctgtaatgcatgaggcgttgcataaccattatactcagaagagcctgtcactgtcgccgggtaaagaagtgcagcttgtggaatcaggaggggggctcgttcaagctggagggagcctgtcgatcagctgcgcagcgtccggaggctcgctaagtaactacgtcctcggttggtttagacaggccccaggcaaggaaagggaatttgttgcggcaataaattggcgaggagatataaccatcgggccacccaatgtagaaggaaggttcactatttcgcgggataacgcgaagaatacgggctatcttcagatgaattcattggctccggacgacactgccgtttactattgcggtgcagggacaccgttgaacccaggcgcgtacatttacgactggtcctacgattactgggggcgcggcacgcaagttaccgtgtccagctga

SEQ ID NO: 2642 - protein, 15 aa, Artificial
  Linker sequence
EPKSCDKTHTCPPCP

SEQ ID NO: 2643 - protein, 24 aa, Artificial
  Linker sequence
GGGGSGGGSEPKSCDKTHTCPPCP

SEQ ID NO: 2644 - protein, 15 aa, Artificial
  Linker sequence
GGGGSGGGGSGGGGS

SEQ ID NO: 2645 - protein, 265 aa, Artificial
  Nanobody sequence
EVQLVESGGGSVQAGGSLRLSCAASGGTFNPYVMAWFRQAPGNEREFVARIRWSGGDAYYDDSVKGRFAITRDAAKNTVHLQMNSLKPEDTAVYYCAAATYGYGSYTYGGSYDLWGQGTQVTVSSGGGGSGGGGSGGGGSEVQLVESGGGSVQAGGSLRLSCAASGGTFNPYVMAWFRQAPGNEREFVARIRWSGGDAYYDDSVKGRFAITRDAAKNTVHLQMNSLKPEDTAVYYCAAATYGYGSYTYGGSYDLWGQGTQVTVSS

SEQ ID NO: 2646 - protein, 255 aa, Artificial
  Nanobody sequence
EVQLVESGGGLVQPGGSLRLSCAASGFTFGSSDMSWVRQAPGKGPEWVSGINSGGGRTLYADSVKGRFTISRDNAKNTLYLQMNSLKSEDTAVYYCATDLYGSSWYTDYWSQGTQVTVSSGGGGSGGGGSGGGGSEVQLVESGGGLVQPGGSLRLSCAASGFTFGSSDMSWVRQAPGKGPEWVSGINSGGGRTLYADSVKGRFTISRDNAKNTLYLQMNSLKSEDTAVYYCATDLYGSSWYTDYWSQGTQVTVSS

SEQ ID NO: 2647 - protein, 249 aa, Artificial
  Nanobody sequence
EVQLVESGGGLVQAGASLRLSCAASGSTLSRYGVGWFRQAPGKERELVASVDWSGSRTYYADSVKGRFTISRDNAKNTGYLQMNSLKPDDTAVYYCAADSSVVPGIEKYDDWGLGTQVTVSSGGGGSEVQLVESGGGLVQAGASLRLSCAASGSTLSRYGVGWFRQAPGKERELVASVDWSGSRTYYADSVKGRFTISRDNAKNTGYLQMNSLKPDDTAVYYCAADSSVVPGIEKYDDWGLGTQVTVSS

SEQ ID NO: 2648 - protein, 269 aa, Artificial
  Nanobody sequence
EVQLVESGGGLVQAGASLRLSCAASGSTLSRYGVGWFRQAPGKERELVASVDWSGSRTYYADSVKGRFTISRDNAKNTGYLQMNSLKPDDTAVYYCAADSSVVPGIEKYDDWGLGTQVTVSSGGGGSGGGGSGGGGSGGGGSGGGGSEVQLVESGGGLVQAGASLRLSCAASGSTLSRYGVGWFRQAPGKERELVASVDWSGSRTYYADSVKGRFTISRDNAKNTGYLQMNSLKPDDTAVYYCAADSSVVPGIEKYDDWGLGTQVTVSS

SEQ ID NO: 2649 - protein, 249 aa, Artificial
  Nanobody sequence
EVQLVESGGDLVQAGGSLRLSCVASGSTYSINAMGWYRQAPGKLRELVAAFRTGGSTDYADSVKGRFTISRDTAKNTVYLQMNSLKPEDTAVYYCNAEVIYYPYDYWGQGTQVTVSSGGGGSGGGGSGGGGSEVQLVESGGDLVQAGGSLRLSCVASGSTYSINAMGWYRQAPGKLRELVAAFRTGGSTDYADSVKGRFTISRDTAKNTVYLQMNSLKPEDTAVYYCNAEVIYYPYDYWGQGTQVTVSS

SEQ ID NO: 2650 - protein, 249 aa, Artificial; identical to SEQ ID NO: 2649
  Nanobody sequence

SEQ ID NO: 2651 - protein, 247 aa, Artificial
  Nanobody sequence
EVQLVESGGGLVQAGASLRLSCAASGSTLSRYGVGWFRQAPGKERELVASVDWSGSRTYYADSVKGRFTISRDNAKNTGYLQMNSLKPDDTAVYYCAADSSVVPGIEKYDDWGLGTQVTVSSGGGGSEVQLVESGGGLVQPGGSLRLSCAASGFTFGSSDMSWVRQAPGKGPEWVSGINSGGGRTLYADSVKGRFTISRDNAKNTLYLQMNSLKSEDTAVYYCATDLYGSSWYTDYWSQGTQVTVSS

SEQ ID NO: 2652 - protein, 267 aa, Artificial
  Nanobody sequence
EVQLVESGGGLVQAGASLRLSCAASGSTLSRYGVGWFRQAPGKERELVASVDWSGSRTYYADSVKGRFTISRDNAKNTGYLQMNSLKPDDTAVYYCAADSSVVPGIEKYDDWGLGTQVTVSSGGGGSGGGGSGGGGSGGGGSGGGGSEVQLVESGGGLVQPGGSLRLSCAASGFTFGSSDMSWVRQAPGKGPEWVSGINSGGGRTLYADSVKGRFTISRDNAKNTLYLQMNSLKSEDTAVYYCATDLYGSSWYTDYWSQGTQVTVSS

SEQ ID NO: 2653 - protein, 272 aa, Artificial
  Nanobody sequence
EVQLVESGGGLVQAGASLRLSCAASGSTLSRYGVGWFRQAPGKERELVASVDWSGSRTYYADSVKGRFTISRDNAKNTGYLQMNSLKPDDTAVYYCAADSSVVPGIEKYDDWGLGTQVTVSSGGGGSGGGGSGGGGSGGGGSGGGGSEVQLVESGGGSVQAGGSLRLSCAASGGTFNPYVMAWFRQAPGNEREFVARIRWSGGDAYYDDSVKGRFAITRDAAKNTVHLQMNSLKPEDTAVYYCAAATYGYGSYTYGGSYDLWGQGTQVTVSS

SEQ ID NO: 2654 - protein, 261 aa, Artificial
  Nanobody sequence
EVQLVESGGGLVQAGASLRLSCAASGSTLSRYGVGWFRQAPGKERELVASVDWSGSRTYYADSVKGRFTISRDNAKNTGYLQMNSLKPDDTAVYYCAADSSVVPGIEKYDDWGLGTQVTVSSGGGGSGGGGSGGGGSEVQLVESGGGLVQAGGSLRLSCAASGRTLSSYRMGWFRQAPGKEREFISTISWNGRSTYYADSVKGRFIFSEDNAKNTVYLQMNSLKPEDTAVYYCAAALIGGYYSDVDAWSYWGPGTQVTVSS

SEQ ID NO: 2655 - protein, 250 aa, Artificial
  Nanobody sequence
EVQLVESGGGSVQAGGSLRLSCAASGGTFNPYVMAWFRQAPGNEREFVARIRWSGGDAYYDDSVKGRFAITRDAAKNTVHLQMNSLKPEDTAVYYCAAATYGYGSYTYGGSYDLWGQGTQVTVSSGGGGSEVQLVESGGGLVQPGGSLRLSCAASGFTFGSSDMSWVRQAPGKGPEWVSGINSGGGRTLYADSVKGRFTISRDNAKNTLYLQMNSLKSEDTAVYYCATDLYGSSWYTDYWSQGTQVTVSS

SEQ ID NO: 2656 - protein, 260 aa, Artificial
  Nanobody sequence
EVQLVESGGGSVQAGGSLRLSCAASGGTFNPYVMAWFRQAPGNEREFVARIRWSGGDAYYDDSVKGRFAITRDAAKNTVHLQMNSLKPEDTAVYYCAAATYGYGSYTYGGSYDLWGQGTQVTVSSGGGGSGGGGSGGGGSEVQLVESGGGLVQPGGSLRLSCAASGFTFGSSDMSWVRQAPGKGPEWVSGINSGGGRTLYADSVKGRFTISRDNAKNTLYLQMNSLKSEDTAVYYCATDLYGSSWYTDYWSQGTQVTVSS

SEQ ID NO: 2657 - protein, 270 aa, Artificial
  Nanobody sequence
EVQLVESGGGSVQAGGSLRLSCAASGGTFNPYVMAWFRQAPGNEREFVARIRWSGGDAYYDDSVKGRFAITRDAAKNTVHLQMNSLKPEDTAVYYCAAATYGYGSYTYGGSYDLWGQGTQVTVSSGGGGSGGGGSGGGGSGGGGSGGGGSEVQLVESGGGLVQPGGSLRLSCAASGFTFGSSDMSWVRQAPGKGPEWVSGINSGGGRTLYADSVKGRFTISRDNAKNTLYLQMNSLKSEDTAVYYCATDLYGSSWYTDYWSQGTQVTVSS

SEQ ID NO: 2658 - protein, 264 aa, Artificial
  Nanobody sequence
EVQLVESGGGSVQAGGSLRLSCAASGGTFNPYVMAWFRQAPGNEREFVARIRWSGGDAYYDDSVKGRFAITRDAAKNTVHLQMNSLKPEDTAVYYCAAATYGYGSYTYGGSYDLWGQGTQVTVSSGGGGSGGGGSGGGGSEVQLVESGGGLVQAGGSLRLSCAASGRTLSSYRMGWFRQAPGKEREFISTISWNGRSTYYADSVKGRFIFSEDNAKNTVYLQMNSLKPEDTAVYYCAAALIGGYYSDVDAWSYWGPGTQVTVSS

SEQ ID NO: 2659 - protein, 256 aa, Artificial
  Nanobody sequence
EVQLVESGGGLVQAGGSLRLSCAASGRTLSSYRMGWFRQAPGKEREFISTISWNGRSTYYADSVKGRFIFSEDNAKNTVYLQMNSLKPEDTAVYYCAAALIGGYYSDVDAWSYWGPGTQVTVSSGGGGSGGGGSGGGGSEVQLVESGGDLVQAGGSLRLSCVASGSTYSINAMGWYRQAPGKLRELVAAFRTGGSTDYADSVKGRFTISRDTAKNTVYLQMNSLKPEDTAVYYCNAEVIYYPYDYWGQGTQVTVSS

SEQ ID NO: 2660 - protein, 262 aa, Artificial
  Nanobody sequence
EVQLVESGGGLVQAGASLRLSCAASGSTLSRYGVGWFRQAPGKERELVASVDWSGSRTYYADSVKGRFTISRDNAKNTGYLQMNSLKPDDTAVYYCAADSSVVPGIEKYDDWGLGTQVTVSSGGGGSGGGGSGGGGSEVQLVESGGGSVQAGGSLRLSCAASGGTFNPYVMAWFRQAPGNEREFVARIRWSGGDAYYDDSVKGRFAITRDAAKNTVHLQMNSLKPEDTAVYYCAAATYGYGSYTYGGSYDLWGQGTQVTVSS

SEQ ID NO: 2661 - protein, 262 aa, Artificial
  Nanobody sequence
EVQLVESGGGSVQAGGSLRLSCAASGGTFNPYVMAWFRQAPGNEREFVARIRWSGGDAYYDDSVKGRFAITRDAAKNTVHLQMNSLKPEDTAVYYCAAATYGYGSYTYGGSYDLWGQGTQVTVSSGGGGSGGGGSGGGGSEVQLVESGGGLVQAGASLRLSCAASGSTLSRYGVGWFRQAPGKERELVASVDWSGSRTYYADSVKGRFTISRDNAKNTGYLQMNSLKPDDTAVYYCAADSSVVPGIEKYDDWGLGTQVTVSS

SEQ ID NO: 2662 - protein, 256 aa, Artificial
  Nanobody sequence
EVQLVESGGDLVQAGGSLRLSCVASGSTYSINAMGWYRQAPGKLRELVAAFRTGGSTDYADSVKGRFTISRDTAKNTVYLQMNSLKPEDTAVYYCNAEVIYYPYDYWGQGTQVTVSSGGGGSGGGGSGGGGSEVQLVESGGGLVQAGGSLRLSCAASGRTLSSYRMGWFRQAPGKEREFISTISWNGRSTYYADSVKGRFIFSEDNAKNTVYLQMNSLKPEDTAVYYCAAALIGGYYSDVDAWSYWGPGTQVTVSS

SEQ ID NO: 2663 - protein, 255 aa, Artificial
  Nanobody sequence
EVQLVESGGGSVQAGGSLRLSCAASGGTFNPYVMAWFRQAPGNEREFVARIRWSGGDAYYDDSVKGRFAITRDAAKNTVHLQMNSLKPEDTAVYYCAAATYGYGSYTYGGSYDLWGQGTQVTVSSGGGGSEVQLVESGGGSVQAGGSLRLSCAASGGTFNPYVMAWFRQAPGNEREFVARIRWSGGDAYYDDSVKGRFAITRDAAKNTVHLQMNSLKPEDTAVYYCAAATYGYGSYTYGGSYDLWGQGTQVTVSS

SEQ ID NO: 2664 - protein, 115 aa, Artificial
  Nanobody sequence
EVQLVESGGGLVQPGESLRLSCAFSGIVFEFYDMGWYRQAPGMQRELVANIASGGSTNLADAVKGRFTISRDNAQKKIDLQMNSLRREDTAVYYCNARYGSREYWGQGTQVTVSS

SEQ ID NO: 2665 - protein, 115 aa, Artificial
  Nanobody sequence
EVQLVESGGGLVQPGESLRLSCAFSGIVFEFYDMGWYRQAPGKQRELVANIASRGSTDLADSVKGRFTISRDNAQKKIDLQMNGLGREDTAVYYCNAQYGSREYWGQGTQVTVSS

SEQ ID NO: 2666 - protein, 115 aa, Artificial
  Nanobody sequence
EVQLVESGGGLAQAGGSLRLSCAVSGEAVGSSATGWYRAVSATERELVARIRSGGSTDYADSVKGRFTVSRDNAKNTVYLQMNSLKPEDTAVYYCNLVSYGEYFWGKGTLVTVSS

SEQ ID NO: 2667 - protein, 124 aa, Artificial
  Nanobody sequence
EVQLVESGGGLVQAGGSLRLSCAASGRTLSSYRLGWFRQAPGKEREFISTISWNGRSTYYADSVKGRFIFSEDEAKNTVHLQMNSLKPEDTAVYYCAAALIGGYYSDVDAWSYWGPGTQVTVSS

SEQ ID NO: 2668 - protein, 117 aa, Artificial; identical to SEQ ID NO: 246
  Nanobody sequence

SEQ ID NO: 2669 - protein, 124 aa, Artificial; identical to SEQ ID NO: 2667
  Nanobody sequence

SEQ ID NO: 2670 - protein, 115 aa, Artificial; identical to SEQ ID NO: 237
  Nanobody sequence

SEQ ID NO: 2671 - protein, 125 aa, Artificial; identical to SEQ ID NO: 245
  Nanobody sequence

SEQ ID NO: 2672 - protein, 124 aa, Artificial
  Nanobody sequence
EVQLVESGGGLVQAGGSLRLSCAASGRTVSSYYMGWFRQAPGNEREFVAAFSWSSSKPYYADSVKGRFTISRDSAGNTVYLQMNSLKPEDTAVYWCGARQIGTYYSDYENYDYWGQGTQVTVSS

SEQ ID NO: 2673 - protein, 124 aa, Artificial
  Nanobody sequence
EVQLVESGGGLVQAGGSLRLSCAASGRAFSRYYMGWFRQAPGKEREVVAAFSWSGGMTYYADSVKGRFTMSRDSASDTVYLQMNSLKPEDTAVYYCGARQMGVYYSDYENYDYWGQGTQVTVSS

SEQ ID NO: 2674 - protein, 124 aa, Artificial
  Nanobody sequence
EVQLVESGGGLVQAGGSLRLSCAASGRTVSSYYMGWFRQAPGNEREFVAAFSWSGSKPYYADSVKGRFTISRDSAGNTVYLQMNSLKPEDTAVYWCGARQIGTYYSDYENYDYWGQGTQVTVSS

SEQ ID NO: 2675 - protein, 125 aa, Artificial
  Nanobody sequence
EVQLVESGGGLVQAGGSLRLSCAASGRTLSSYRLSWFRQAPGKEREFVATHSWDGRRTYYADSVKGRFTFSRDNAKNTVYLQLNSLKPEDTAVYHCAAATLIGGYYSDLDNYDYWGPGTQVTVSS

SEQ ID NO: 2676 - protein, 124 aa, Artificial; identical to SEQ ID NO: 2673
  Nanobody sequence

SEQ ID NO: 2677 - protein, 124 aa, Artificial; identical to SEQ ID NO: 2667
  Nanobody sequence

SEQ ID NO: 2678 - protein, 115 aa, Artificial; identical to SEQ ID NO: 237
  Nanobody sequence

SEQ ID NO: 2679 - protein, 115 aa, Artificial
  Nanobody sequence
EVQLVESGGGLVQAGGSLRLSCAVSGDTFDNSAAGWYRATSETQRELVARIRSSGSTNYADSVKGRFTVSRDNAKNTVYLQMNSLKPEDTAVYYCNVVSYGEYFWGKGTLVTVSS

SEQ ID NO: 2680 - protein, 124 aa, Artificial
  Nanobody sequence
EVQLVESGGGLVQAGGSLRLSCAASGRTFDTYFVGWFRQAPGKERDFVAAISWSGDRTFYADSVKGRFTISRDNAKNTEYLQMNSLKPEDTAVYYCAAREYGRLYSDSEAYDYWGQGTQVTVSS

SEQ ID NO: 2681 - protein, 125 aa, Artificial; identical to SEQ ID NO: 245
  Nanobody sequence

SEQ ID NO: 2682 - protein, 119 aa, Artificial
  Nanobody sequence
EVQLVESGGGLVQPGGSLRLSCAASGFTFGNYDMSWVRQAPGKGPEWVSGINTGGSTLYADSVKGRFTISRDNAKNTLYLQMNSLKSEDTAVYYCAKDLYGSTWYTDYWSQGTQVTVSS

SEQ ID NO: 2683 - protein, 124 aa, Artificial
  Nanobody sequence
EMQLVESGGGLVQAGDSLRLSCAASGDTFSWYVMAWFRQAPGKEREFVTWINRSGASTYYADSVKGRFTIFRDNDKNTVYLQMNSLKPEDTAVYYCAAGGFYGLRTTEERYDTWGQGTQVTVSS

SEQ ID NO: 2684 - protein, 120 aa, Artificial
  Nanobody sequence
EVQLVESGGGLVQPGGSLRLSCAASGFTFGSSDMSWVRQAPGKGPEWVSGINSGGGRTLYADSVKGRFTISRDNAKNTLYLQMNSLKSEDTAVYYCATDLYGSSWYTDYWSQGTQVTVSS

SEQ ID NO: 2685 - protein, 125 aa, Artificial; identical to SEQ ID NO: 245
  Nanobody sequence

SEQ ID NO: 2686 - protein, 125 aa, Artificial; identical to SEQ ID NO: 245
  Nanobody sequence

SEQ ID NO: 2687 - protein, 117 aa, Artificial
  Nanobody sequence
EVQLVESGGGLVQPGGSLRLSCAASGFTFGSSDMSWVRQAPGKGPEWVSGINSGGGITDYANSVKGRFTISRDNAKNTLYLQMNSLKPEDTAVYSCATDFWGSTWSGLPGTQVTVSS

SEQ ID NO: 2688 - protein, 117 aa, Artificial; identical to SEQ ID NO: 246
  Nanobody sequence

SEQ ID NO: 2689 - protein, 125 aa, Artificial
  Nanobody sequence
EVQLVESGGGLVQAGGSLRLSCAASGGTFSPYVMAWFRQAPGNEREFVARIRWSSINTAYDDSVKGRFTISRDNAKSTVYLQMDSLKPEDTAVYYCAAATYGYGSYTYQGSYDHWGQGTQVTVSS

SEQ ID NO: 2690 - protein, 119 aa, Artificial
  Nanobody sequence
EVQLVESGGGLVQPGGSLRLSCEASGFTFGSRDMHWVRQAPGKGGPEWVSGINSGASNTHYADSVKGRFTISRDNAKNTLYLQMNSLKAEDTAVYYCATEFWPGVYDTSTPGTQVTVSS

SEQ ID NO: 2691 - protein, 125 aa, Artificial; identical to SEQ ID NO: 245
  Nanobody sequence

SEQ ID NO: 2692 - protein, 115 aa, Artificial; identical to SEQ ID NO: 2666
  Nanobody sequence

SEQ ID NO: 2693 - protein, 119 aa, Artificial
  Nanobody sequence
EVQLVESGGGLVQPGGSLRLSCAASGFTFGSYDMSWVRQAPGKGSEWVSHINTGGGSTTYADSVKGRFTISRDNAKNTLYLQMSSLKPEDTAVYYCATGLYGGSTDDYWGQGTQVTVSS

SEQ ID NO: 2694 - protein, 117 aa, Artificial; identical to SEQ ID NO: 246
  Nanobody sequence

SEQ ID NO: 2695 - protein, 125 aa, Artificial; identical to SEQ ID NO: 245
  Nanobody sequence

SEQ ID NO: 2696 - protein, 119 aa, Artificial
  Nanobody sequence
EVQLVESGGGLVQPGGSLRLSCAASGFTFGSHDMSWVRQAPGKGSEWVSGIKSGGGSTLYADSVKGRFAISRDNAKNTLYLQMNSLKPEDTAVYYCATDLYGSTWYPGEDRGTQVTVSS

SEQ ID NO: 2697 - protein, 125 aa, Artificial; identical to SEQ ID NO: 245
  Nanobody sequence

SEQ ID NO: 2698 - protein, 124 aa, Artificial; identical to SEQ ID NO: 2680
  Nanobody sequence

SEQ ID NO: 2699 - protein, 116 aa, Artificial
  Nanobody sequence
EVQLVESGGGLVQAGGSLRLSCTSSGSIFNFIMGWYRQAPGKQRELVADITRGDERNYLDAVKGRFIITRDSAKNTIYLQMNSLQPADSGVYWCHGLGVVSNREYWGQGTQVTVSS

SEQ ID NO: 2700 - protein, 30 aa, Artificial
  Framework sequence
EVQLVESGGGLVQPGESLRLSCAFSGIVFE

SEQ ID NO: 2701 - protein, 30 aa, Artificial; identical to SEQ ID NO: 2700
  Framework sequence

SEQ ID NO: 2702 - protein, 30 aa, Artificial
  Framework sequence
EVQLVESGGGLAQAGGSLRLSCAVSGEAVG

SEQ ID NO: 2703 - protein, 30 aa, Artificial; identical to SEQ ID NO: 523
  Framework sequence

SEQ ID NO: 2704 - protein, 30 aa, Artificial; identical to SEQ ID NO: 528
  Framework sequence

SEQ ID NO: 2705 - protein, 30 aa, Artificial; identical to SEQ ID NO: 523
  Framework sequence

SEQ ID NO: 2706 - protein, 30 aa, Artificial; identical to SEQ ID NO: 519
  Framework sequence

SEQ ID NO: 2707 - protein, 30 aa, Artificial; identical to SEQ ID NO: 527
  Framework sequence

SEQ ID NO: 2708 - protein, 30 aa, Artificial; identical to SEQ ID NO: 652
  Framework sequence

SEQ ID NO: 2709 - protein, 30 aa, Artificial
  Framework sequence
EVQLVESGGGLVQAGGSLRLSCAASGRAFS

SEQ ID NO: 2710 - protein, 30 aa, Artificial; identical to SEQ ID NO: 652
  Framework sequence

SEQ ID NO: 2711 - protein, 30 aa, Artificial; identical to SEQ ID NO: 523
  Framework sequence

SEQ ID NO: 2712 - protein, 30 aa, Artificial; identical to SEQ ID NO: 2709
  Framework sequence

SEQ ID NO: 2713 - protein, 30 aa, Artificial; identical to SEQ ID NO: 523
  Framework sequence

SEQ ID NO: 2714 - protein, 30 aa, Artificial; identical to SEQ ID NO: 519
  Framework sequence

SEQ ID NO: 2715 - protein, 30 aa, Artificial
  Framework sequence
EVQLVESGGGLVQAGGSLRLSCAVSGDTFD

SEQ ID NO: 2716 - protein, 30 aa, Artificial
  Framework sequence
EVQLVESGGGLVQAGGSLRLSCAASGRTFD

SEQ ID NO: 2717 - protein, 30 aa, Artificial; identical to SEQ ID NO: 527
  Framework sequence

SEQ ID NO: 2718 - protein, 30 aa, Artificial; identical to SEQ ID NO: 426
  Framework sequence

SEQ ID NO: 2719 - protein, 30 aa, Artificial
  Framework sequence
EMQLVESGGGLVQAGDSLRLSCAASGDTFS

SEQ ID NO: 2720 - protein, 30 aa, Artificial; identical to SEQ ID NO: 426
  Framework sequence

SEQ ID NO: 2721 - protein, 30 aa, Artificial; identical to SEQ ID NO: 527
  Framework sequence

SEQ ID NO: 2722 - protein, 30 aa, Artificial; identical to SEQ ID NO: 527
  Framework sequence

SEQ ID NO: 2723 - protein, 30 aa, Artificial; identical to SEQ ID NO: 426
  Framework sequence

SEQ ID NO: 2724 - protein, 30 aa, Artificial; identical to SEQ ID NO: 528
  Framework sequence

SEQ ID NO: 2725 - protein, 30 aa, Artificial; identical to SEQ ID NO: 409
  Framework sequence

SEQ ID NO: 2726 - protein, 30 aa, Artificial
  Framework sequence
EVQLVESGGGLVQPGGSLRLSCEASGFTFG

SEQ ID NO: 2727 - protein, 30 aa, Artificial; identical to SEQ ID NO: 527
  Framework sequence

SEQ ID NO: 2728 - protein, 30 aa, Artificial; identical to SEQ ID NO: 2702
  Framework sequence

SEQ ID NO: 2729 - protein, 30 aa, Artificial; identical to SEQ ID NO: 426
  Framework sequence

SEQ ID NO: 2730 - protein, 30 aa, Artificial; identical to SEQ ID NO: 528
  Framework sequence

SEQ ID NO: 2731 - protein, 30 aa, Artificial; identical to SEQ ID NO: 527
  Framework sequence

SEQ ID NO: 2732 - protein, 30 aa, Artificial; identical to SEQ ID NO: 426
  Framework sequence

SEQ ID NO: 2733 - protein, 30 aa, Artificial; identical to SEQ ID NO: 527
  Framework sequence

SEQ ID NO: 2734 - protein, 30 aa, Artificial; identical to SEQ ID NO: 2716
  Framework sequence

SEQ ID NO: 2735 - protein, 30 aa, Artificial
  Framework sequence
EVQLVESGGGLVQAGGSLRLSCTSSGSIFN

SEQ ID NO: 2736 - protein, 5 aa, Artificial
  CDR1 sequence
FYDMG

SEQ ID NO: 2737 - protein, 5 aa, Artificial
  CDR1 sequence
FYDMG

SEQ ID NO: 2738 - protein, 5 aa, Artificial
  CDR1 sequence
SSATG

SEQ ID NO: 2739 - protein, 5 aa, Artificial
  CDR1 sequence
SYRLG

SEQ ID NO: 2740 - protein, 5 aa, Artificial
  CDR1 sequence
INAMG

SEQ ID NO: 2741 - protein, 5 aa, Artificial
  CDR1 sequence
SYRLG

SEQ ID NO: 2742 - protein, 5 aa, Artificial
  CDR1 sequence
NSAAG

SEQ ID NO: 2743 - protein, 5 aa, Artificial
  CDR1 sequence
PYVMA

SEQ ID NO: 2744 - protein, 5 aa, Artificial
  CDR1 sequence
SYYMG

SEQ ID NO: 2745 - protein, 5 aa, Artificial
  CDR1 sequence
RYYMG

SEQ ID NO: 2746 - protein, 5 aa, Artificial
  CDR1 sequence
SYYMG

SEQ ID NO: 2747 - protein, 5 aa, Artificial
  CDR1 sequence
SYRLS

SEQ ID NO: 2748 - protein, 5 aa, Artificial
  CDR1 sequence
RYYMG

SEQ ID NO: 2749 - protein, 5 aa, Artificial
  CDR1 sequence
SYRLG

SEQ ID NO: 2750 - protein, 5 aa, Artificial
  CDR1 sequence
NSAAG

SEQ ID NO: 2751 - protein, 5 aa, Artificial
  CDR1 sequence
NSAAG

SEQ ID NO: 2752 - protein, 5 aa, Artificial
  CDR1 sequence
TYFVG

SEQ ID NO: 2753 - protein, 5 aa, Artificial
  CDR1 sequence
PYVMA

SEQ ID NO: 2754 - protein, 5 aa, Artificial
  CDR1 sequence
NYDMS

SEQ ID NO: 2755 - protein, 5 aa, Artificial
  CDR1 sequence
WYVMA

SEQ ID NO: 2756 - protein, 5 aa, Artificial
  CDR1 sequence
SSDMS

SEQ ID NO: 2757 - protein, 5 aa, Artificial
  CDR1 sequence
PYVMA

SEQ ID NO: 2758 - protein, 5 aa, Artificial
  CDR1 sequence
PYVMA

SEQ ID NO: 2759 - protein, 5 aa, Artificial
  CDR1 sequence
SSDMS

SEQ ID NO: 2760 - protein, 5 aa, Artificial
  CDR1 sequence
INAMG

SEQ ID NO: 2761 - protein, 5 aa, Artificial
  CDR1 sequence
PYVMA

SEQ ID NO: 2762 - protein, 5 aa, Artificial
  CDR1 sequence
SRDMH

SEQ ID NO: 2763 - protein, 5 aa, Artificial
  CDR1 sequence
PYVMA

SEQ ID NO: 2764 - protein, 5 aa, Artificial
  CDR1 sequence
SSATG

SEQ ID NO: 2765 - protein, 5 aa, Artificial
  CDR1 sequence
SYDMS

SEQ ID NO: 2766 - protein, 5 aa, Artificial
  CDR1 sequence
INAMG

SEQ ID NO: 2767 - protein, 5 aa, Artificial
  CDR1 sequence
PYVMA

SEQ ID NO: 2768 - protein, 5 aa, Artificial
  CDR1 sequence
SHDMS

SEQ ID NO: 2769 - protein, 5 aa, Artificial
  CDR1 sequence
PYVMA

SEQ ID NO: 2770 - protein, 5 aa, Artificial
  CDR1 sequence
TYFVG

SEQ ID NO: 2771 - protein, 4 aa, Artificial
  CDR1 sequence
FIMG

SEQ ID NO: 2772 - protein, 14 aa, Artificial
  Framework sequence
WYRQAPGMQRELVA

SEQ ID NO: 2773 - protein, 14 aa, Artificial
  Framework sequence
WYRQAPGKQRELVA

SEQ ID NO: 2774 - protein, 14 aa, Artificial
  Framework sequence
WYRAVSATERELVA

SEQ ID NO: 2775 - protein, 14 aa, Artificial
  Framework sequence
WFRQAPGKEREFIS

SEQ ID NO: 2776 - protein, 14 aa, Artificial
  Framework sequence
WYRQAPGKLRELVA

SEQ ID NO: 2777 - protein, 14 aa, Artificial
  Framework sequence
WFRQAPGKEREFIS

SEQ ID NO: 2778 - protein, 14 aa, Artificial
  Framework sequence
WYRATSETQRELVA

SEQ ID NO: 2779 - protein, 14 aa, Artificial
  Framework sequence
WFRQAPGNEREFVA

SEQ ID NO: 2780 - protein, 14 aa, Artificial
  Framework sequence
WFRQAPGNEREFVA

SEQ ID NO: 2781 - protein, 14 aa, Artificial
  Framework sequence
WFRQAPGKEREVVA

SEQ ID NO: 2782 - protein, 14 aa, Artificial
  Framework sequence
WFRQAPGNEREFVA

SEQ ID NO: 2783 - protein, 14 aa, Artificial
  Framework sequence
WFRQAPGKEREFVA

SEQ ID NO: 2784 - protein, 14 aa, Artificial
  Framework sequence
WFRQAPGKEREVVA

SEQ ID NO: 2785 - protein, 14 aa, Artificial
  Framework sequence
WFRQAPGKEREFIS

SEQ ID NO: 2786 - protein, 14 aa, Artificial
  Framework sequence
WYRATSETQRELVA

SEQ ID NO: 2787 - protein, 14 aa, Artificial
  Framework sequence
WYRATSETQRELVA

SEQ ID NO: 2788 - protein, 14 aa, Artificial
  Framework sequence
WFRQAPGKERDFVA

SEQ ID NO: 2789 - protein, 14 aa, Artificial
  Framework sequence
WFRQAPGNEREFVA

SEQ ID NO: 2790 - protein, 14 aa, Artificial
  Framework sequence
WVRQAPGKGPEWVS

SEQ ID NO: 2791 - protein, 14 aa, Artificial
  Framework sequence
WFRQAPGKEREFVT

SEQ ID NO: 2792 - protein, 14 aa, Artificial
  Framework sequence
WVRQAPGKGPEWVS

SEQ ID NO: 2793 - protein, 14 aa, Artificial
  Framework sequence
WFRQAPGNEREFVA

SEQ ID NO: 2794 - protein, 14 aa, Artificial
  Framework sequence
WFRQAPGNEREFVA

SEQ ID NO: 2795 - protein, 14 aa, Artificial
  Framework sequence
WVRQAPGKGPEWVS

SEQ ID NO: 2796 - protein, 14 aa, Artificial
  Framework sequence
WYRQAPGKLRELVA

SEQ ID NO: 2797 - protein, 14 aa, Artificial
  Framework sequence
WFRQAPGNEREFVA

SEQ ID NO: 2798 - protein, 14 aa, Artificial
  Framework sequence
WVRQAPGKGGPEWV

SEQ ID NO: 2799 - protein, 14 aa, Artificial
  Framework sequence
WFRQAPGNEREFVA

SEQ ID NO: 2800 - protein, 14 aa, Artificial
  Framework sequence
WYRAVSATERELVA

SEQ ID NO: 2801 - protein, 14 aa, Artificial
  Framework sequence
WVRQAPGKGSEWVS

SEQ ID NO: 2802 - protein, 14 aa, Artificial
  Framework sequence
WYRQAPGKLRELVA

SEQ ID NO: 2803 - protein, 14 aa, Artificial
  Framework sequence
WFRQAPGNEREFVA

SEQ ID NO: 2804 - protein, 14 aa, Artificial
  Framework sequence
WVRQAPGKGSEWVS

SEQ ID NO: 2805 - protein, 14 aa, Artificial
  Framework sequence
WFRQAPGNEREFVA

SEQ ID NO: 2806 - protein, 14 aa, Artificial
  Framework sequence
WFRQAPGKERDFVA

SEQ ID NO: 2807 - protein, 14 aa, Artificial
  Framework sequence
WYRQAPGKQRELVA

SEQ ID NO: 2808 - protein, 16 aa, Artificial
  CDR2 sequence
NIASGGSTNLADAVKG

SEQ ID NO: 2809 - protein, 16 aa, Artificial
  CDR2 sequence
NIASRGSTDLADSVKG

SEQ ID NO: 2810 - protein, 16 aa, Artificial
  CDR2 sequence
RIRSGGSTDYADSVKG

SEQ ID NO: 2811 - protein, 17 aa, Artificial
  CDR2 sequence
TISWNGRSTYYADSVKG

SEQ ID NO: 2812 - protein, 16 aa, Artificial
  CDR2 sequence
AFRTGGSTDYADSVKG

SEQ ID NO: 2813 - protein, 17 aa, Artificial
  CDR2 sequence
TISWNGRSTYYADSVKG

SEQ ID NO: 2814 - protein, 16 aa, Artificial
  CDR2 sequence
RIRSSGSTNYADSVKG

SEQ ID NO: 2815 - protein, 17 aa, Artificial
  CDR2 sequence
RIRWSGGDAYYDDSVKG

SEQ ID NO: 2816 - protein, 17 aa, Artificial
  CDR2 sequence
AFSWSSSKPYYADSVKG

SEQ ID NO: 2817 - protein, 17 aa, Artificial
  CDR2 sequence
AFSWSGGMTYYADSVKG

SEQ ID NO: 2818 - protein, 17 aa, Artificial
  CDR2 sequence
AFSWSGSKPYYADSVKG

SEQ ID NO: 2819 - protein, 17 aa, Artificial
  CDR2 sequence
THSWDGRRTYYADSVKG

SEQ ID NO: 2820 - protein, 17 aa, Artificial
  CDR2 sequence
AFSWSGGMTYYADSVKG

SEQ ID NO: 2821 - protein, 17 aa, Artificial
  CDR2 sequence
TISWNGRSTYYADSVKG

SEQ ID NO: 2822 - protein, 16 aa, Artificial
  CDR2 sequence
RIRSSGSTNYADSVKG

SEQ ID NO: 2823 - protein, 16 aa, Artificial
  CDR2 sequence
RIRSSGSTNYADSVKG

SEQ ID NO: 2824 - protein, 17 aa, Artificial
  CDR2 sequence
AISWSGDRTFYADSVKG

SEQ ID NO: 2825 - protein, 17 aa, Artificial
  CDR2 sequence
RIRWSGGDAYYDDSVKG

SEQ ID NO: 2826 - protein, 16 aa, Artificial
  CDR2 sequence
GINTGGSTLYADSVKG

SEQ ID NO: 2827 - protein, 17 aa, Artificial
  CDR2 sequence
WINRSGASTYYADSVKG

SEQ ID NO: 2828 - protein, 17 aa, Artificial
  CDR2 sequence
GINSGGGRTLYADSVKG

SEQ ID NO: 2829 - protein, 17 aa, Artificial
  CDR2 sequence
RIRWSGGDAYYDDSVKG

SEQ ID NO: 2830 - protein, 17 aa, Artificial
  CDR2 sequence
RIRWSGGDAYYDDSVKG

SEQ ID NO: 2831 - protein, 17 aa, Artificial
  CDR2 sequence
GINSGGGITDYANSVKG

SEQ ID NO: 2832 - protein, 16 aa, Artificial
  CDR2 sequence
AFRTGGSTDYADSVKG

SEQ ID NO: 2833 - protein, 17 aa, Artificial
  CDR2 sequence
RIRWSSINTAYDDSVKG

SEQ ID NO: 2834 - protein, 18 aa, Artificial
  CDR2 sequence
SGINSGASNTHYADSVKG

SEQ ID NO: 2835 - protein, 17 aa, Artificial
  CDR2 sequence
RIRWSGGDAYYDDSVKG

SEQ ID NO: 2836 - protein, 16 aa, Artificial
  CDR2 sequence
RIRSGGSTDYADSVKG

SEQ ID NO: 2837 - protein, 17 aa, Artificial
  CDR2 sequence
HINTGGGSTTYADSVKG

SEQ ID NO: 2838 - protein, 16 aa, Artificial
  CDR2 sequence
AFRTGGSTDYADSVKG

SEQ ID NO: 2839 - protein, 17 aa, Artificial
  CDR2 sequence
RIRWSGGDAYYDDSVKG

SEQ ID NO: 2840 - protein, 17 aa, Artificial
  CDR2 sequence
GIKSGGGSTLYADSVKG

SEQ ID NO: 2841 - protein, 17 aa, Artificial
  CDR2 sequence
RIRWSGGDAYYDDSVKG

SEQ ID NO: 2842 - protein, 17 aa, Artificial
  CDR2 sequence
AISWSGDRTFYADSVKG

SEQ ID NO: 2843 - protein, 16 aa, Artificial
  CDR2 sequence
DITRGDERNYLDAVKG

SEQ ID NO: 2844 - protein, 32 aa, Artificial
  Framework sequence
RFTISRDNAQKKIDLQMNSLRREDTAVYYCNA

SEQ ID NO: 2845 - protein, 32 aa, Artificial
  Framework sequence
RFTISRDNAQKKIDLQMNGLGREDTAVYYCNA

SEQ ID NO: 2846 - protein, 32 aa, Artificial
  Framework sequence
RFTVSRDNAKNTVYLQMNSLKPEDTAVYYCNL

SEQ ID NO: 2847 - protein, 32 aa, Artificial
  Framework sequence
RFIFSEDEAKNTVHLQMNSLKPEDTAVYYCAA

SEQ ID NO: 2848 - protein, 32 aa, Artificial; identical to SEQ ID NO: 1656
  Framework sequence

SEQ ID NO: 2849 - protein, 32 aa, Artificial; identical to SEQ ID NO: 2847
  Framework sequence

SEQ ID NO: 2850 - protein, 32 aa, Artificial; identical to SEQ ID NO: 1647
  Framework sequence

SEQ ID NO: 2851 - protein, 32 aa, Artificial; identical to SEQ ID NO: 1652
  Framework sequence

SEQ ID NO: 2852 - protein, 32 aa, Artificial
  Framework sequence
RFTISRDSAGNTVYLQMNSLKPEDTAVYWCGA

SEQ ID NO: 2853 - protein, 32 aa, Artificial
  Framework sequence
RFTMSRDSASDTVYLQMNSLKPEDTAVYYCGA

SEQ ID NO: 2854 - protein, 32 aa, Artificial; identical to SEQ ID NO: 2852
  Framework sequence

SEQ ID NO: 2855 - protein, 32 aa, Artificial
  Framework sequence
RFTFSRDNAKNTVYLQLNSLKPEDTAVYHCAA

SEQ ID NO: 2856 - protein, 32 aa, Artificial; identical to SEQ ID NO: 2853
  Framework sequence

SEQ ID NO: 2857 - protein, 32 aa, Artificial; identical to SEQ ID NO: 2847
  Framework sequence

SEQ ID NO: 2858 - protein, 32 aa, Artificial; identical to SEQ ID NO: 1647
  Framework sequence

SEQ ID NO: 2859 - protein, 32 aa, Artificial; identical to SEQ ID NO: 1647
  Framework sequence

SEQ ID NO: 2860 - protein, 32 aa, Artificial
  Framework sequence
RFTISRDNAKNTEYLQMNSLKPEDTAVYYCAA

SEQ ID NO: 2861 - protein, 32 aa, Artificial; identical to SEQ ID NO: 1652
  Framework sequence

SEQ ID NO: 2862 - protein, 32 aa, Artificial
  Framework sequence
RFTISRDNAKNTLYLQMNSLKSEDTAVYYCAK

SEQ ID NO: 2863 - protein, 32 aa, Artificial
  Framework sequence
RFTIFRDNDKNTVYLQMNSLKPEDTAVYYCAA

SEQ ID NO: 2864 - protein, 32 aa, Artificial
  Framework sequence
RFTISRDNAKNTLYLQMNSLKSEDTAVYYCAT

SEQ ID NO: 2865 - protein, 32 aa, Artificial; identical to SEQ ID NO: 1652
  Framework sequence

SEQ ID NO: 2866 - protein, 32 aa, Artificial; identical to SEQ ID NO: 1652
  Framework sequence

SEQ ID NO: 2867 - protein, 32 aa, Artificial
  Framework sequence
RFTISRDNAKNTLYLQMNSLKPEDTAVYSCAT

SEQ ID NO: 2868 - protein, 32 aa, Artificial; identical to SEQ ID NO: 1656
  Framework sequence

SEQ ID NO: 2869 - protein, 32 aa, Artificial
  Framework sequence
RFTISRDNAKSTVYLQMDSLKPEDTAVYYCAA

SEQ ID NO: 2870 - protein, 32 aa, Artificial
  Framework sequence
RFTISRDNAKNTLYLQMNSLKAEDTAVYYCAT

SEQ ID NO: 2871 - protein, 32 aa, Artificial; identical to SEQ ID NO: 1652
  Framework sequence

SEQ ID NO: 2872 - protein, 32 aa, Artificial; identical to SEQ ID NO: 2846
  Framework sequence

SEQ ID NO: 2873 - protein, 32 aa, Artificial
  Framework sequence
RFTISRDNAKNTLYLQMSSLKPEDTAVYYCAT

SEQ ID NO: 2874 - protein, 32 aa, Artificial; identical to SEQ ID NO: 1656
  Framework sequence

SEQ ID NO: 2875 - protein, 32 aa, Artificial; identical to SEQ ID NO: 1652
  Framework sequence

SEQ ID NO: 2876 - protein, 32 aa, Artificial
  Framework sequence
RFAISRDNAKNTLYLQMNSLKPEDTAVYYCAT

SEQ ID NO: 2877 - protein, 32 aa, Artificial; identical to SEQ ID NO: 1652
  Framework sequence

SEQ ID NO: 2878 - protein, 32 aa, Artificial; identical to SEQ ID NO: 2860
  Framework sequence

SEQ ID NO: 2879 - protein, 32 aa, Artificial
  Framework sequence
RFIITRDSAKNTIYLQMNSLQPADSGVYWCHG

SEQ ID NO: 2880 - protein, 7 aa, Artificial
  CDR3 sequence
RYGSREY

SEQ ID NO: 2881 - protein, 7 aa, Artificial
  CDR3 sequence
QYGSREY

SEQ ID NO: 2882 - protein, 7 aa, Artificial
  CDR3 sequence
VSYGEYF

SEQ ID NO: 2883 - protein, 15 aa, Artificial
  CDR3 sequence
ALIGGYYSDVDAWSY

SEQ ID NO: 2884 - protein, 9 aa, Artificial
  CDR3 sequence
EVIYYPYDY

SEQ ID NO: 2885 - protein, 15 aa, Artificial
  CDR3 sequence
ALIGGYYSDVDAWSY

SEQ ID NO: 2886 - protein, 7 aa, Artificial
  CDR3 sequence
VSYGEYF

SEQ ID NO: 2887 - protein, 16 aa, Artificial
  CDR3 sequence
ATYGYGSYTYGGSYDL

SEQ ID NO: 2888 - protein, 15 aa, Artificial
  CDR3 sequence
RQIGTYYSDYENYDY

SEQ ID NO: 2889 - protein, 15 aa, Artificial
  CDR3 sequence
RQMGVYYSDYENYDY

SEQ ID NO: 2890 - protein, 15 aa, Artificial
  CDR3 sequence
RQIGTYYSDYENYDY

SEQ ID NO: 2891 - protein, 16 aa, Artificial
  CDR3 sequence
ATLIGGYYSDLDNYDY

SEQ ID NO: 2892 - protein, 15 aa, Artificial
  CDR3 sequence
RQMGVYYSDYENYDY

SEQ ID NO: 2893 - protein, 15 aa, Artificial
  CDR3 sequence
ALIGGYYSDVDAWSY

SEQ ID NO: 2894 - protein, 7 aa, Artificial
  CDR3 sequence
VSYGEYF

SEQ ID NO: 2895 - protein, 7 aa, Artificial
  CDR3 sequence
VSYGEYF

SEQ ID NO: 2896 - protein, 15 aa, Artificial
  CDR3 sequence
REYGRLYSDSEAYDY

SEQ ID NO: 2897 - protein, 16 aa, Artificial
  CDR3 sequence
ATYGYGSYTYGGSYDL

SEQ ID NO: 2898 - protein, 11 aa, Artificial
  CDR3 sequence
DLYGSTWYTDY

SEQ ID NO: 2899 - protein, 15 aa, Artificial
  CDR3 sequence
GGFYGLRTTEERYDT

SEQ ID NO: 2900 - protein, 11 aa, Artificial
  CDR3 sequence
DLYGSSWYTDY

SEQ ID NO: 2901 - protein, 16 aa, Artificial
  CDR3 sequence
ATYGYGSYTYGGSYDL

SEQ ID NO: 2902 - protein, 16 aa, Artificial
  CDR3 sequence
ATYGYGSYTYGGSYDL

SEQ ID NO: 2903 - protein, 8 aa, Artificial
  CDR3 sequence
DFWGSTWS

SEQ ID NO: 2904 - protein, 9 aa, Artificial
  CDR3 sequence
EVIYYPYDY

SEQ ID NO: 2905 - protein, 16 aa, Artificial
  CDR3 sequence
ATYGYGSYTYQGSYDH

SEQ ID NO: 2906 - protein, 9 aa, Artificial
  CDR3 sequence
EFWPGVYDT

SEQ ID NO: 2907 - protein, 16 aa, Artificial
  CDR3 sequence
ATYGYGSYTYGGSYDL

SEQ ID NO: 2908 - protein, 7 aa, Artificial
  CDR3 sequence
VSYGEYF

SEQ ID NO: 2909 - protein, 10 aa, Artificial
  CDR3 sequence
GLYGGSTDDY

SEQ ID NO: 2910 - protein, 9 aa, Artificial
  CDR3 sequence
EVIYYPYDY

SEQ ID NO: 2911 - protein, 16 aa, Artificial
  CDR3 sequence
ATYGYGSYTYGGSYDL

SEQ ID NO: 2912 - protein, 10 aa, Artificial
  CDR3 sequence
DLYGSTWYPG

SEQ ID NO: 2913 - protein, 16 aa, Artificial
  CDR3 sequence
ATYGYGSYTYGGSYDL

SEQ ID NO: 2914 - protein, 15 aa, Artificial
  CDR3 sequence
REYGRLYSDSEAYDY

SEQ ID NO: 2915 - protein, 9 aa, Artificial
  CDR3 sequence
LGVVSNREY

SEQ ID NO: 2916 - protein, 11 aa, Artificial
  Framework sequence
WGQGTQVTVSS

SEQ ID NO: 2917 - protein, 11 aa, Artificial
  Framework sequence
WGQGTQVTVSS

SEQ ID NO: 2918 - protein, 11 aa, Artificial
  Framework sequence
WGKGTLVTVSS

SEQ ID NO: 2919 - protein, 11 aa, Artificial
  Framework sequence
WGPGTQVTVSS

SEQ ID NO: 2920 - protein, 11 aa, Artificial
  Framework sequence
WGQGTQVTVSS

SEQ ID NO: 2921 - protein, 11 aa, Artificial
  Framework sequence
WGPGTQVTVSS

SEQ ID NO: 2922 - protein, 11 aa, Artificial
  Framework sequence
WGKGTLVTVSS

SEQ ID NO: 2923 - protein, 11 aa, Artificial
  Framework sequence
WGQGTQVTVSS

SEQ ID NO: 2924 - protein, 11 aa, Artificial
  Framework sequence
WGQGTQVTVSS

SEQ ID NO: 2925 - protein, 11 aa, Artificial
  Framework sequence
WGQGTQVTVSS

SEQ ID NO: 2926 - protein, 11 aa, Artificial
  Framework sequence
WGQGTQVTVSS

SEQ ID NO: 2927 - protein, 11 aa, Artificial
  Framework sequence
WGPGTQVTVSS

SEQ ID NO: 2928 - protein, 11 aa, Artificial
  Framework sequence
WGQGTQVTVSS

SEQ ID NO: 2929 - protein, 11 aa, Artificial
  Framework sequence
WGPGTQVTVSS

SEQ ID NO: 2930 - protein, 11 aa, Artificial
  Framework sequence
WGKGTLVTVSS

SEQ ID NO: 2931 - protein, 11 aa, Artificial
  Framework sequence
WGKGTLVTVSS

SEQ ID NO: 2932 - protein, 11 aa, Artificial
  Framework sequence
WGQGTQVTVSS

SEQ ID NO: 2933 - protein, 11 aa, Artificial
  Framework sequence
WGQGTQVTVSS

SEQ ID NO: 2934 - protein, 11 aa, Artificial
  Framework sequence
WSQGTQVTVSS

SEQ ID NO: 2935 - protein, 11 aa, Artificial
  Framework sequence
WGQGTQVTVSS

SEQ ID NO: 2936 - protein, 11 aa, Artificial
  Framework sequence
WSQGTQVTVSS

SEQ ID NO: 2937 - protein, 11 aa, Artificial
  Framework sequence
WGQGTQVTVSS

SEQ ID NO: 2938 - protein, 11 aa, Artificial
  Framework sequence
WGQGTQVTVSS

SEQ ID NO: 2939 - protein, 11 aa, Artificial
  Framework sequence
GLPGTQVTVSS

SEQ ID NO: 2940 - protein, 11 aa, Artificial
  Framework sequence
WGQGTQVTVSS

SEQ ID NO: 2941 - protein, 11 aa, Artificial
  Framework sequence
WGQGTQVTVSS

SEQ ID NO: 2942 - protein, 11 aa, Artificial
  Framework sequence
STPGTQVTVSS

SEQ ID NO: 2943 - protein, 11 aa, Artificial
  Framework sequence
WGQGTQVTVSS

SEQ ID NO: 2944 - protein, 11 aa, Artificial
  Framework sequence
WGKGTLVTVSS

SEQ ID NO: 2945 - protein, 11 aa, Artificial
  Framework sequence
WGQGTQVTVSS

SEQ ID NO: 2946 - protein, 11 aa, Artificial
  Framework sequence
WGQGTQVTVSS

SEQ ID NO: 2947 - protein, 11 aa, Artificial
  Framework sequence
WGQGTQVTVSS

SEQ ID NO: 2948 - protein, 11 aa, Artificial
  Framework sequence
EDRGTQVTVSS

SEQ ID NO: 2949 - protein, 11 aa, Artificial
  Framework sequence
WGQGTQVTVSS

SEQ ID NO: 2950 - protein, 11 aa, Artificial
  Framework sequence
WGQGTQVTVSS

SEQ ID NO: 2951 - protein, 11 aa, Artificial
  Framework sequence
WGQGTQVTVSS

SEQ ID NO: 2952 - protein, 5 aa, Artificial
  Linker sequence
GGGGS

SEQ ID NO: 2953 - protein, 7 aa, Artificial
  Linker sequence
SGGSGGS

SEQ ID NO: 2954 - protein, 10 aa, Artificial
  Linker sequence
GGGGSGGGGS

SEQ ID NO: 2955 - protein, 18 aa, Artificial
  Linker sequence
GGGGSGGGGSGGGGGGGS

SEQ ID NO: 2956 - protein, 20 aa, Artificial
  Linker sequence
GGGGSGGGGSGGGGSGGGGS

SEQ ID NO: 2957 - protein, 25 aa, Artificial
  Linker sequence
GGGGSGGGGSGGGGSGGGGSGGGGS

SEQ ID NO: 2958 - protein, 30 aa, Artificial
  Linker sequence
GGGGSGGGGSGGGGSGGGGSGGGGSGGGGS

SEQ ID NO: 2959 - protein, 35 aa, Artificial
  Linker sequence
GGGGSGGGGSGGGGSGGGGSGGGGSGGGGSGGGGS

SEQ ID NO: 2960 - protein, 502 aa, Artificial
  Nanobody sequence
EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGGSGGGGSEVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2961 - protein, 511 aa, Artificial
  Nanobody sequence
EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGGSGGGGSEVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSSGGGGSGGGSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2962 - protein, 549 aa, Artificial
  Nanobody sequence
EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGGSGGGGSEVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSSELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2963 - protein, 487 aa, Artificial
  Nanobody sequence
EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKEVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSS

SEQ ID NO: 2964 - protein, 496 aa, Artificial
  Nanobody sequence
EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKEVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSS

SEQ ID NO: 2965 - protein, 534 aa, Artificial
  Nanobody sequence
EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKEVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSS

SEQ ID NO: 2966 - protein, 496 aa, Artificial
  Nanobody sequence
EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSEVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSS

SEQ ID NO: 2967 - protein, 505 aa, Artificial
  Nanobody sequence
EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSEVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSS

SEQ ID NO: 2968 - protein, 543 aa, Artificial
  Nanobody sequence
EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSEVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSS

SEQ ID NO: 2969 - protein, 502 aa, Artificial; identical to SEQ ID NO: 2960
  Nanobody sequence

SEQ ID NO: 2970 - protein, 487 aa, Artificial; identical to SEQ ID NO: 2963
  Nanobody sequence

SEQ ID NO: 2971 - protein, 407 aa, Artificial
  Nanobody sequence
EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSAAAEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSAAAEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSAAAEQKLISEEDLNGAAHHHHHH

SEQ ID NO: 2972 - protein, 419 aa, Artificial
  Nanobody sequence
EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSAAAEQKLISEEDLNGAAHHHHHH

SEQ ID NO: 2973 - protein, 441 aa, Artificial
  Nanobody sequence
EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGGSGGGGSGGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGGSGGGGSGGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSAAAEQKLISEEDLNGAAHHHHHH

SEQ ID NO: 2974 - protein, 431 aa, Artificial
  Nanobody sequence
EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGGSGGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGGSGGGGSEVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSSAAAEQKLISEEDLNGAAHHHHHH

SEQ ID NO: 2975 - protein, 431 aa, Artificial
  Nanobody sequence
EVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSSGGGGSGGGGSGGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGGSGGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSAAAEQKLISEEDLNGAAHHHHHH

SEQ ID NO: 2976 - protein, 431 aa, Artificial
  Nanobody sequence
EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGGSGGGGSEVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSSGGGGSGGGGSGGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSAAAEQKLISEEDLNGAAHHHHHH

SEQ ID NO: 2977 - protein, 437 aa, Artificial
  Nanobody sequence
EVQLVESGGGLVQAGGSLRLSCEASGRTFSSYGMGWFRQAPGKEREFVAAVSRLSGPRTVYADSVKGRFTISRDNAENTVYLQMNSLKPEDTAVYTCAAELTNRNPGAYYYTWAYDYWGQGTQVTVSSGGGGSGGGGSGGGGSEVQLVESGGGLVQAGGSLRLSCEASGRTFSSYGMGWFRQAPGKEREFVAAVSRLSGPRTVYADSVKGRFTISRDNAENTVYLQMNSLKPEDTAVYTCAAELTNRNPGAYYYTWAYDYWGQGTQVTVSSGGGGSGGGGSGGGGSEVQLVESGGGLVQAGGSLRLSCEASGRTFSSYGMGWFRQAPGKEREFVAAVSRLSGPRTVYADSVKGRFTISRDNAENTVYLQMNSLKPEDTAVYTCAAELTNRNPGAYYYTWAYDYWGQGTQVTVSSAAAEQKLISEEDLNGAAHHHHHH

SEQ ID NO: 2978 - protein, 408 aa, Artificial
  Nanobody sequence
EVQLLESGGGLVQPGGSLRISCAASGGSLSNYVLGWFRQAPGKGREFVAAINWRGDITIGPPNVEGRFTISRDNSKNTLYLQMNSLRPEDTAVYYCGAGTPLNPGAYIYDWSYDYWGQGTLVTVSSGGGGSGGGGSGGGGSEVQLLESGGGLVQPGGSLRISCAASGGSLSNYVLGWFRQAPGKGREFVAAINWRGDITIGPPNVEGRFTISRDNSKNTLYLQMNSLRPEDTAVYYCGAGTPLNPGAYIYDWSYDYWGQGTLVTVSSGGGGSGGGGSGGGGSEVQLLESGGGLVQPGGSLRISCAASGGSLSNYVLGWFRQAPGKGREFVAAINWRGDITIGPPNVEGRFTISRDNSKNTLYLQMNSLRPEDTAVYYCGAGTPLNPGAYIYDWSYDYWGQGTLVTVSS

SEQ ID NO: 2979 - protein, 408 aa, Artificial
  Nanobody sequence
EVQLLESGGGLVQPGGSLRLSCAASGGSLSNYVLGWFRQAPGKGREFVAAINWRDDITIGPPNVEGRFTISRDNAKNTLYLQMNSLRPEDTAVYYCGAGTPLNPGAYIYDWSYDYWGQGTLVTVSSGGGGSGGGGSGGGGSEVQLLESGGGLVQPGGSLRLSCAASGGSLSNYVLGWFRQAPGKGREFVAAINWRDDITIGPPNVEGRFTISRDNAKNTLYLQMNSLRPEDTAVYYCGAGTPLNPGAYIYDWSYDYWGQGTLVTVSSGGGGSGGGGSGGGGSEVQLLESGGGLVQPGGSLRLSCAASGGSLSNYVLGWFRQAPGKGREFVAAINWRDDITIGPPNVEGRFTISRDNAKNTLYLQMNSLRPEDTAVYYCGAGTPLNPGAYIYDWSYDYWGQGTLVTVSS

SEQ ID NO: 2980 - protein, 408 aa, Artificial
  Nanobody sequence
EVQLLESGGGLVQPGGSLRLSCAASGGSLSNYVLGWFRQAPGKGREFVAAINWRDDITIGPPNVEGRFTISRDNSKNTLYLQMNSLRPEDTAVYYCGAGTPLNPGAYIYDWSYDYWGQGTLVTVSSGGGGSGGGGSGGGGSEVQLLESGGGLVQPGGSLRLSCAASGGSLSNYVLGWFRQAPGKGREFVAAINWRDDITIGPPNVEGRFTISRDNSKNTLYLQMNSLRPEDTAVYYCGAGTPLNPGAYIYDWSYDYWGQGTLVTVSSGGGGSGGGGSGGGGSEVQLLESGGGLVQPGGSLRLSCAASGGSLSNYVLGWFRQAPGKGREFVAAINWRDDITIGPPNVEGRFTISRDNSKNTLYLQMNSLRPEDTAVYYCGAGTPLNPGAYIYDWSYDYWGQGTLVTVSS

SEQ ID NO: 2981 - protein, 126 aa, Artificial
  Nanobody sequence
EVQLLESGGGLVQPGGSLRLSCAASGGSLSNYVLGWFRQAPGKGREFVAAINWRGDITIGPPNVEGRFTISRDNAKNTLYLQMNSLAPEDTAVYYCGAGTPLNPGAYIYDWSYDYWGQGTLVTVSS

SEQ ID NO: 2982 - protein, 126 aa, Artificial
  Nanobody sequence
EVQLLESGGGLVQPGGSLRISCAASGGSLSNYVLGWFRQAPGKGREFVAAINWRGDITIGPPNVEGRFTISRDNSKNTLYLQMNSLAPEDTAVYYCGAGTPLNPGAYIYDWSYDYWGQGTLVTVSS

SEQ ID NO: 2983 - protein, 126 aa, Artificial
  Nanobody sequence
EVQLLESGGGLVQPGGSLRISCAASGGSLSNYVLGWFRQAPGKGREFVAAINWRGDITIGPPNVEGRFTISRDNSKNTLYLQMNSLRPEDTAVYYCGAGTPLNPGAYIYDWSYDYWGQGTLVTVSS

SEQ ID NO: 2984 - protein, 126 aa, Artificial
  Nanobody sequence
EVQLLESGGGLVQPGGSLSISCAASGGSLSNYVLGWFRQAPGKGREFVAAINWRGDITIGPPNVEGRFTISRDNSKNTLYLQMNSLRPDDTAVYYCGAGTPLNPGAYIYDWSYDYWGQGTLVTVSS

SEQ ID NO: 2985 - protein, 126 aa, Artificial
  Nanobody sequence
EVQLLESGGGLVQPGGSLSISCAASGGSLSNYVLGWFRQAPGKGREFVAAINWRGDITIGPPNVEGRFTISRDNSKNTLYLQMNSLAPEDTAVYYCGAGTPLNPGAYIYDWSYDYWGQGTLVTVSS

SEQ ID NO: 2986 - protein, 126 aa, Artificial
  Nanobody sequence
EVQLLESGGGLVQPGGSLRLSCAASGGSLSNYVLGWFRQAPGKGREFVAAINWRDDITIGPPNVEGRFTISRDNAKNTLYLQMNSLRPEDTAVYYCGAGTPLNPGAYIYDWSYDYWGQGTLVTVSS

SEQ ID NO: 2987 - protein, 126 aa, Artificial
  Nanobody sequence
EVQLLESGGGLVQPGGSLSISCAASGGSLSNYVLGWFRQAPGKGREFVAAINWRGDITIGPPNVEGRFTISRDNAKNTLYLQMNSLAPDDTAVYYCGAGTPLNPGAYIYDWSYDYWGQGTLVTVSS

SEQ ID NO: 2988 - protein, 126 aa, Artificial
  Nanobody sequence
EVQLLESGGGLVQPGGSLSISCAASGGSLSNYVLGWFRQAPGKGREFVAAINWRGDITIGPPNVEGRFTISRDNAKNTLYLQMNSLRPEDTAVYYCGAGTPLNPGAYIYDWSYDYWGQGTLVTVSS

SEQ ID NO: 2989 - protein, 126 aa, Artificial; identical to SEQ ID NO: 2984
  Nanobody sequence

SEQ ID NO: 2990 - protein, 126 aa, Artificial
  Nanobody sequence
EVQLLESGGGLVQPGGSLSISCAASGGSLSNYVLGWFRQAPGKGREFVAAINWRGDITIGPPNVEGRFTISRDNAKNTGYLQMNSLAPDDTAVYYCGAGTPLNPGAYIYDWSYDYWGQGTLVTVSS

SEQ ID NO: 2991 - protein, 126 aa, Artificial
  Nanobody sequence
EVQLLESGGGLVQAGGSLSISCAASGGSLSNYVLGWFRQAPGKGREFVAAINWRGDITIGPPNVEGRFTISRDNAKNTGYLQMNSLAPDDTAVYYCGAGTPLNPGAYIYDWSYDYWGQGTLVTVSS

SEQ ID NO: 2992 - protein, 126 aa, Artificial
  Nanobody sequence
EVQLLESGGGLVQPGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGQGTLVTVSS

SEQ ID NO: 2993 - protein, 126 aa, Artificial
  Nanobody sequence
EVQLLESGGGLVQPGGSLRLSCAASGGSLSNYVLGWFRQAPGKGREFVAAINWRGDITIGPPNVEGRFTISRDNAKNTGYLQMNSLAPEDTAVYYCGAGTPLNPGAYIYDWSYDYWGQGTLVTVSS

SEQ ID NO: 2994 - protein, 126 aa, Artificial
  Nanobody sequence
EVQLLESGGGLVQPGGSLRLSCAASGGSLSNYVLGWFRQAPGKGREFVAAINWRGDITIGPPNVEGRFTISRDNSKNTLYLQMNSLAPEDTAVYYCGAGTPLNPGAYIYDWSYDYWGQGTLVTVSS

SEQ ID NO: 2995 - protein, 126 aa, Artificial
  Nanobody sequence
EVQLLESGGGLVQAGGSLRLSCAASGGSLSNYVLGWFRQAPGKGREFVAAINWRGDITIGPPNVEGRFTISRDNAKNTLYLQMNSLAPEDTAVYYCGAGTPLNPGAYIYDWSYDYWGQGTLVTVSS

SEQ ID NO: 2996 - protein, 126 aa, Artificial
  Nanobody sequence
EVQLLESGGGLVQPGGSLRLSCAASGGSLSNYVLGWFRQAPGKGREFVAAINWRGDITIGPPNVEGRFTISRDNSKNTLYLQMNSLRPEDTAVYYCGAGTPLNPGAYIYDWSYDYWGQGTLVTVSS

SEQ ID NO: 2997 - protein, 126 aa, Artificial
  Nanobody sequence
EVQLLESGGGLVQPGGSLRLSCAASGGSLSNYVLGWFRQAPGKGREFVAAINWRDDITIGPPNVEGRFTISRDNSKNTLYLQMNSLRPEDTAVYYCGAGTPLNPGAYIYDWSYDYWGQGTLVTVSS

SEQ ID NO: 2998 - protein, 271 aa, Artificial
  Nanobody sequence
EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGGSGGGGSEVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSS

SEQ ID NO: 2999 - protein, 280 aa, Artificial
  Nanobody sequence
VQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGGSGGGGSGGGGSGGGGSEVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSS

SEQ ID NO: 3000 - protein, 291 aa, Artificial
  Nanobody sequence
EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGGSGGGGSGGGGSGGGGSGGGGSGGGGSEVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSS

SEQ ID NO: 3001 - protein, 265 aa, Artificial
  Nanobody sequence
EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGSEVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSS

SEQ ID NO: 3002 - protein, 263 aa, Artificial
  Nanobody sequence
EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSS

SEQ ID NO: 3003 - protein, 269 aa, Artificial
  Nanobody sequence
EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSS

SEQ ID NO: 3004 - protein, 261 aa, Artificial
  Nanobody sequence
EVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSSGGGGSGGGSEVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSS

SEQ ID NO: 3005 - protein, 267 aa, Artificial
  Nanobody sequence
EVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSSGGGGSGGGGSGGGGSEVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSS

SEQ ID NO: 3006 - protein, 263 aa, Artificial
  Nanobody sequence
EVQLVESGGGLVQPGGSLRLSCAASGRTFSSIAMGWFRQAPGKEREFVAAISWSRGRTFYADSVKGRFIISRDDAANTAYLQMNSLKPEDTAVYYCAVDTASWNSGSFIYDWAYDHWGQGTQVTVSSGGGGSGGGSEVQLVESGGGLVQPGGSLRLSCAASGRTFSSIAMGWFRQAPGKEREFVAAISWSRGRTFYADSVKGRFIISRDDAANTAYLQMNSLKPEDTAVYYCAVDTASWNSGSFIYDWAYDHWGQGTQVTVSS

SEQ ID NO: 3007 - protein, 269 aa, Artificial
  Nanobody sequence
EVQLVESGGGLVQPGGSLRLSCAASGRTFSSIAMGWFRQAPGKEREFVAAISWSRGRTFYADSVKGRFIISRDDAANTAYLQMNSLKPEDTAVYYCAVDTASWNSGSFIYDWAYDHWGQGTQVTVSSGGGGSGGGGSGGGGSEVQLVESGGGLVQPGGSLRLSCAASGRTFSSIAMGWFRQAPGKEREFVAAISWSRGRTFYADSVKGRFIISRDDAANTAYLQMNSLKPEDTAVYYCAVDTASWNSGSFIYDWAYDHWGQGTQVTVSS

SEQ ID NO: 3008 - protein, 267 aa, Artificial
  Nanobody sequence
EVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSSGGGGSGGGGSGGGGSEVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSS

SEQ ID NO: 3009 - protein, 262 aa, Artificial
  Nanobody sequence
EVQLVESGGGWVQAGGSLRLSCAASGRAFSSYAMGWIRQAPGKEREFVAGIDQSGESTAYGASASGRFIISRDNAKNTVHLLMNSLQSDDTAVYYCVADGVLATTLNWDYWGQGTQVTVSSGGGGSGGGGSGGGGSGGGGSEVQLVESGGGWVQAGGSLRLSCAASGRAFSSYAMGWIRQAPGKEREFVAGIDQSGESTAYGASASGRFIISRDNAKNTVHLLMNSLQSDDTAVYYCVADGVLATTLNWDYWGQGTQVTVSS

SEQ ID NO: 3010 - protein, 272 aa, Artificial
  Nanobody sequence
EVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSSGGGGSGGGGSGGGGGGGSEVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSS

SEQ ID NO: 3011 - protein, 267 aa, Artificial
  Nanobody sequence
EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGGSGGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSS

SEQ ID NO: 3012 - protein, 264 aa, Artificial
  Nanobody sequence
EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGSEVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSS

SEQ ID NO: 3013 - protein, 270 aa, Artificial
  Nanobody sequence
EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGGSGGGGSEVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSS

SEQ ID NO: 3014 - protein, 280 aa, Artificial
  Nanobody sequence
EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGGSGGGGSGGGGSGGGGSEVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSS

SEQ ID NO: 3015 - protein, 268 aa, Artificial
  Nanobody sequence
EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSS

SEQ ID NO: 3016 - protein, 268 aa, Artificial
  Nanobody sequence
EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSS

SEQ ID NO: 3017 - protein, 268 aa, Artificial
  Nanobody sequence
EVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSS

SEQ ID NO: 3018 - protein, 268 aa, Artificial; identical to SEQ ID NO: 3017
  Nanobody sequence

SEQ ID NO: 3019 - protein, 264 aa, Artificial
  Nanobody sequence
EVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSSGGGGSGGGSEVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSS

SEQ ID NO: 3020 - protein, 270 aa, Artificial
  Nanobody sequence
EVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSSGGGGSGGGGSGGGGSEVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSS

SEQ ID NO: 3021 - protein, 280 aa, Artificial
  Nanobody sequence
EVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSSGGGGSGGGGSGGGGSGGGGSGGGGSEVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSS

SEQ ID NO: 3022 - protein, 268 aa, Artificial
  Nanobody sequence
EVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSS

SEQ ID NO: 3023 - protein, 267 aa, Artificial
  Nanobody sequence
EVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSSGGGGSGGGGSGGGGSEVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSS

SEQ ID NO: 3024 - protein, 411 aa, Artificial
  Nanobody sequence
EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSS

SEQ ID NO: 3025 - protein, 410 aa, Artificial
  Nanobody sequence
EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSS

SEQ ID NO: 3026 - protein, 410 aa, Artificial
  Nanobody sequence
EVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSS

SEQ ID NO: 3027 - protein, 410 aa, Artificial
  Nanobody sequence
EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSS

SEQ ID NO: 3028 - protein, 408 aa, Artificial
  Nanobody sequence
EVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSSGGGGSGGGGSGGGGSEVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSSGGGGSGGGGSGGGGSEVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSS

SEQ ID NO: 3029 - protein, 414 aa, Artificial
  Nanobody sequence
EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGGSGGGGSEVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSGGGGSGGGGSEVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSS

SEQ ID NO: 3030 - protein, 411 aa, Artificial
  Nanobody sequence
EVQLVESGGGLVQPGGSLRLSCAASGRTFSSIAMGWFRQAPGKEREFVAAISWSRGRTFYADSVKGRFIISRDDAANTAYLQMNSLKPEDTAVYYCAVDTASWNSGSFIYDWAYDHWGQGTQVTVSSGGGGSGGGGSGGGGSEVQLVESGGGLVQPGGSLRLSCAASGRTFSSIAMGWFRQAPGKEREFVAAISWSRGRTFYADSVKGRFIISRDDAANTAYLQMNSLKPEDTAVYYCAVDTASWNSGSFIYDWAYDHWGQGTQVTVSSGGGGSGGGGSGGGGSEVQLVESGGGLVQPGGSLRLSCAASGRTFSSIAMGWFRQAPGKEREFVAAISWSRGRTFYADSVKGRFIISRDDAANTAYLQMNSLKPEDTAVYYCAVDTASWNSGSFIYDWAYDHWGQGTQVTVSS

SEQ ID NO: 3031 - protein, 408 aa, Artificial
  Nanobody sequence
EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGGSGGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGGSGGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSS

SEQ ID NO: 3032 - protein, 384 aa, Artificial
  Nanobody sequence
EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSAAAEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSAAAEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSS

SEQ ID NO: 3033 - protein, 396 aa, Artificial
  Nanobody sequence
EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSS

SEQ ID NO: 3034 - protein, 418 aa, Artificial
  Nanobody sequence
EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGGSGGGGSGGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGGSGGGGSGGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSS

SEQ ID NO: 3035 - protein, 408 aa, Artificial
  Nanobody sequence
EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGGSGGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGGSGGGGSEVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSS

SEQ ID NO: 3036 - protein, 408 aa, Artificial
  Nanobody sequence
EVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSSGGGGSGGGGSGGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGGSGGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSS

SEQ ID NO: 3037 - protein, 408 aa, Artificial
  Nanobody sequence
EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGGSGGGGSEVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSSGGGGSGGGGSGGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSS

SEQ ID NO: 3038 - protein, 414 aa, Artificial
  Nanobody sequence
EVQLVESGGGLVQAGGSLRLSCEASGRTFSSYGMGWFRQAPGKEREFVAAVSRLSGPRTVYADSVKGRFTISRDNAENTVYLQMNSLKPEDTAVYTCAAELTNRNPGAYYYTWAYDYWGQGTQVTVSSGGGGSGGGGSGGGGSEVQLVESGGGLVQAGGSLRLSCEASGRTFSSYGMGWFRQAPGKEREFVAAVSRLSGPRTVYADSVKGRFTISRDNAENTVYLQMNSLKPEDTAVYTCAAELTNRNPGAYYYTWAYDYWGQGTQVTVSSGGGGSGGGGSGGGGSEVQLVESGGGLVQAGGSLRLSCEASGRTFSSYGMGWFRQAPGKEREFVAAVSRLSGPRTVYADSVKGRFTISRDNAENTVYLQMNSLKPEDTAVYTCAAELTNRNPGAYYYTWAYDYWGQGTQVTVSS

SEQ ID NO: 3039 - DNA, 45 bp, Artificial
  Primer sequence
aactggaagaattcgcggccgcaggaatttttttttttttttttt

SEQ ID NO: 3040 - DNA, 22 bp, Artificial
  Primer sequence
aggtsmarctgcagsagtcwgg

SEQ ID NO: 3041 - DNA, 53 bp, Artificial
  Primer sequence
aacagttaagcttccgcttgcggccgcggagctggggtcttcgctgtggtgcg

SEQ ID NO: 3042 - DNA, 53 bp, Artificial
  Primer sequence
aacagttaagcttccgcttgcggccgctggttgtggttttggtgtcttgggtt

SEQ ID NO: 3043 - DNA, 54 bp, Artificial
  Primer sequence
aacagttaagcttccgcttgcggccgctacttcattcgttcctgaggagacggt

SEQ ID NO: 3044 - DNA, 21 bp, Artificial
  Primer sequence
ggataacaatttcacacagga

SEQ ID NO: 3045 - protein, 32 aa, Artificial
  Myc-His tag
EPKTPKPQPQPQPQPQPNPTTESKCPHHHHHH

SEQ ID NO: 3046 - protein, 123 aa, Artificial
  Nanobody sequence
QVQLQESGGGLVQPGGSLRLSCTASRTDISFNPMAWYRQAPGQQRELVASITSGGTTNYANSVKGRFTISRDNPKNTMYLQMNSLKPEDTAVYYCNGRGPRYTTTGWITDDYWGQGTQVTVSS

SEQ ID NO: 3047 - protein, 123 aa, Artificial
  Nanobody sequence
QVQLQQSGGGLVQPGGSLRLSCAASRSDFAFNPMGWYRQAPGKQRELVAVLTTGGTTNYADSVKGRFTISRDNARNTVYLQMNSLKPEDTAVYYCYARGPRKAPTGWITDDYWGQGTQVTVSS

SEQ ID NO: 3048 - protein, 123 aa, Artificial
  Nanobody sequence
QVQLQESGGGLVQPGGSLRLSCAASRSGFSFNPMGWYRQAPGKQRELVATITSGGTTNYADSVKGRFTISTDNAKTTVFLQMNSLKPEDTAVYYCNARGPRRGTAGWITDDYWGQGTQVTVSS

SEQ ID NO: 3049 - protein, 123 aa, Artificial
  Nanobody sequence
QVQLQESGGGLVQPGGSLRLSCAASRTDISFNPMGWYRQAPGKQRELVATMTSGGTTGYADSVKGRFTISRDNPKNTLYLQMNSLEPEDTAVYYCHARGPRYATTGWFTDDYWGQGTQVTVSS

SEQ ID NO: 3050 - protein, 123 aa, Artificial
  Nanobody sequence
QVQLQESGGGLVQPGGSLRLSCAASRSGFVFNPMGWYRQAPGKQRELVAVITASLTTNYADSVKGRFTISRDNTGNTAYLQMNSLKPEDTAVYYCYGRGPRKAPTGWITDDYWGQGTQVTVSS

SEQ ID NO: 3051 - protein, 123 aa, Artificial
  Nanobody sequence
QVQLQQSGGGLVQAGGSLRLSCAASGSGFSFNPMGWYRQAPGKQRELVASITSGGTTNYVDSVKGRFTISRGNAKNTVYLQMNSLKPEDTAVYYCAAEGPRRRGSTWYTDNYWGQGTQVTVSS

SEQ ID NO: 3052 - protein, 123 aa, Artificial
  Nanobody sequence
QVQLQESGGGLVQPGGSLRLSCAASVSGFIFNPMGWYRQARGKQREEVAVLTTGGTTKYADSVKDRFTISRDNARNTVDLQMNSLKPEDTAVYYCYARGPRHVPTGWITDDYWGQGTQVTVSS

SEQ ID NO: 3053 - protein, 123 aa, Artificial
  Nanobody sequence
QVQLQQSGGGLVQPGGSLRLSCAASSSGFSFNPMGWYRQAPGKQRELVATMTSGGTTNYADSVKGRFTISRDNAKTTVYLQMNSLKPEDTAVYYCNARGPRRATTGWITDDYWGQGTQVTVSS

SEQ ID NO: 3054 - protein, 123 aa, Artificial
  Nanobody sequence
QVQLQESGGGLVQAGGSLRLSCAASGSGFSFNPMGWYRQAPGKQRELVASITSGGTTNYVDSVKGRFTISRGNAKNTVYLQMNSLKPEDTAVYYCAAEGPRRRGSTWYTDNYWGQGTQVTVSS

SEQ ID NO: 3055 - protein, 123 aa, Artificial
  Nanobody sequence
QVQLQQSGGGLVQPGGSLRLSCAASRGDISFNPMGWYRQAPGKQRELVATITNGGTTNYADSVKGRFTISRDNAETAVYLQMNSLKPEDTAVYYCNARGPRHATTGWYTDDYWGQGTQVTVSS

SEQ ID NO: 3056 - protein, 123 aa, Artificial
  Nanobody sequence
QVQLQESGGGLVQPGGSLRLSCAASRSGFSFNPMGWYRQAPGKQRELVATITSGGTTNYADSVKGRFTISTDNAKTTVYLQMNSLKPEDTAVYYCNGRGPRRATTGWITDDYWGQGTQVTVSS

SEQ ID NO: 3057 - protein, 123 aa, Artificial
  Nanobody sequence
QVQLQESGGGLVQPGGSLRLSCAASRSDFAFNPMGWYRQAPGKQRELVAVLTTGGTTNYADSVKGRFTISRDNARNTVYLQMNSLKPEDTAVYYCYARGPRKAPTGWITDDYWGQGTQVTVSS

SEQ ID NO: 3058 - protein, 123 aa, Artificial
  Nanobody sequence
QVQLQQSGGGLVQAGGSLRLSCAASGNIISFNPMGWHRQAPGKQRELVASITSGGSISYVDSVKGRFTISRDSAKNTIYLQMNSLKPEDTAVYFCAGEGPRRRGSTWYTDTYWGQGTQVTVSS

SEQ ID NO: 3059 - protein, 123 aa, Artificial
  Nanobody sequence
QVQLQQSGGGLVQPGGSLRLSCAASRSGFSFNPMGWYRQAPGKQRELVATITSGGTTNYADSVKGRFTISTDNAKTTVFLQMNSLKPEDTAVYYCNGRGPRRGTAGWFTDDYWGQGTQVTVSS

SEQ ID NO: 3060 - protein, 123 aa, Artificial
  Nanobody sequence
QVQLQQSGGGLVQPGGSLRLSCAASRSDISFNPMGWYRQAPGKQRELVATISNGGTTNYADSVKGRFTISQDNAKTTVYLQMNSLKPEDTAVYYCNGRGPRYATTGWYTDDYWGQGTQVTVSS

SEQ ID NO: 3061 - protein, 123 aa, Artificial
  Nanobody sequence
QVQLQESGGGLVQPGGSLRLSCAASRSDISFNPMGWYRQAPGKQRELVATISNGGTTNYADSVKGRFTISQDNAKTTVYLQMNSLKPEDTAVYYCNGRGPRYATTGWYTDDYWGQGTQVTVSS

SEQ ID NO: 3062 - protein, 121 aa, Artificial
  Nanobody sequence
QVQLQESGGGLVQPGGSLRLSCAASGSIFSINRMGWYRQAPGKQRELVAAITYGGSTNYADSVKGRFTISRDNAKNTVYLQMNSLKPEDTAVYYCNAGSTYSPFGDKYDYWGQGTQVTVSS

SEQ ID NO: 3063 - protein, 123 aa, Artificial
  Nanobody sequence
QVQLQQSGGGLVQAGGSLRLSCAASGSAFSINTMGWYRQAPGKQRELVAVISSGSGGSTNYADSVKGRFTISRDNAKNTVYLHMNSLKPEDTAVYYCNAGSRFNPFGSAYDYWGQGTQVTVSS

SEQ ID NO: 3064 - protein, 121 aa, Artificial
  Nanobody sequence
QVQLQQSGGGLVQPGGSLRLSCAASGSTFSINAMGWYRQAPGKQRELVAAISSGGSTNYADSVKGRFTISRDNAKNTVYLQMNSLKPEDTAVYYCNAGSRFNPFGSAYDYWGQGTQVTVSS

SEQ ID NO: 3065 - protein, 121 aa, Artificial
  Nanobody sequence
QVQLQQSGGGLVQAGGSLRLSCAASGSSFSINAMGWYRQAPGKQRELVAAISSGGSANYADSVKGRFTISRDNAKNTVYLQMNSLKPEDTAVYYCNAGSRFNPFGSAYDYWGQGTQVTVSS

SEQ ID NO: 3066 - protein, 121 aa, Artificial
  Nanobody sequence
QVQLQESGGGLVQAGGSLRLSCAASGSTFSINAMGWYRQAPGKQRELVAAISSGGSTNYADSVKGRFTISRDNAKNTVYLQMNSLKPEDTAVYYCNAGSRFNPFGSAYDYWGQGTQVTVSS

SEQ ID NO: 3067 - protein, 125 aa, Artificial
  Nanobody sequence
QVQLQESGGGLVQAGDSLRLSCAASGRTFNSLTMAWFRQAPGKDRDFVSVVNWDGDRTNYADSVKGRFTIFRDNAKNTVYLQMNGLKPDDTAIYRCAARWDYGLWRPSTYNYAYWGQGTQVIVSS

SEQ ID NO: 3068 - protein, 128 aa, Artificial
  Nanobody sequence
QVQLQESGGGLVQAGGSLRLSCAFSGDTFSFYTLGWFRQAPGKEREFVAATSNIGGYIYYGDSVKGRFTISGDNAKNTVYLQMSSLKPEDTAVYYCAATLRSGSMWYQNVRVNDNPYWGQGTQVTVSS

SEQ ID NO: 3069 - protein, 124 aa, Artificial
  Nanobody sequence
QVQLQESGGGLVQAGGSLRLSCAASGRPFSSAAMGWFRQAPGKEREFVSAISYTGDVTRYADSVKGRFTISRDNTRNTLTLEMNSLKPEDTAVYYCAARTYAGVRAHTYDYDYWGQGTQVTVSS

SEQ ID NO: 3070 - protein, 122 aa, Artificial
  Nanobody sequence
QVQLQESGGGLVQAGGSLRLSCAASGRSLSRYAMGWFRQAPGKEREFVATKTSGGVTYYGASVKGRFTISRDNAKNMVYLQMNSLNPEDTAIYYCAAGTDAIFKPWMLPDYWGQGTQVTVSG

SEQ ID NO: 3071 - protein, 127 aa, Artificial
  Nanobody sequence
QVQLQESGGGLVETGGSLRLSCAASGRTFGGYALAWFRQAPGKGREFVAAVTWTSGTTNYAGSVKDRFTVSRDNAGNTMYLQMNSLRPEDTAVYICGAASGYRSPDRLSEPNWVNYWGQGTQVTVSS

SEQ ID NO: 3072 - protein, 127 aa, Artificial
  Nanobody sequence
QVQLQESGGGLVQTGGSLRLSCAASGRTFGGYAMAWFRQAPRKGREFVASVTWNGGATDYAGSVKDRFTVSRDTANNTMYLQMNSLKPEDTAVYICGAASGYRSTDRLSDPGWTNYWGQGTQVTVSS

SEQ ID NO: 3073 - protein, 127 aa, Artificial
  Nanobody sequence
QVQLQESGGGLVQTGGSLRLSCAASGRTFGGYAMAWFRQVPGKGREFVAAVTWSSGTTNYARSVKDRFIVSRDNANNTMYLQMNSLKPEDTAVYICGAASGYRSTDRLSEPAWINYWGQGTQVTVSS

SEQ ID NO: 3074 - protein, 127 aa, Artificial
  Nanobody sequence
QVQLQESGGGLVQTGGSLRLSCAASGRTFGGYAMAWFRQAPGKGREFVAAVTWSSGTTNYAGSVKDRFTVSRDNANNTMYLQMNSLKPEDTAVYICGAASGYRSTDRLSTPEWINYWGQGTQVTVSS

SEQ ID NO: 3075 - protein, 127 aa, Artificial
  Nanobody sequence
QVQLQESGGGLVQTGGSLRLSCAASGRTFGGYAMAWFRQAPGKGREFVAAVTWSAGTTNYAGSVKDRFTVSRDNANNTMYLQMNSLKPEDTAVYICGAATGYRSTDRLAEPGWVNYWGQGTQVTVSS

SEQ ID NO: 3076 - protein, 127 aa, Artificial
  Nanobody sequence
QVQLQQSGGGLVQTGGSLRLSCAASGRTFGGYAMAWFRQAPGKGREFVAAVTWSAGTTNYAGSVKDRFTVSRDNANNTMYLQMNSLKPEDTAVYICGAASGYRSTDRLSEPAWINYWGQGTQVTVSS

SEQ ID NO: 3077 - protein, 127 aa, Artificial
  Nanobody sequence
QVQLQESGGGLVQTGGSLRLSCAASGRTFGGYAMAWFRQAPGKGREFVAAVTWSAGTTNYAGSVKDRFTVSRDNANNTMYLQMNSLKPEDTAVYICGAATGYRSTDRLTEPAWVNYWGQGTQVTVSS

SEQ ID NO: 3078 - protein, 127 aa, Artificial
  Nanobody sequence
QVQLQESGGGLVQAGGSLRLSCATSGRPFGGYAMAWFRQAPGKGREFVAAVTWSAGTTNYAGSVKDRFTVSRDNANNTMYLQMNSLKPEDTAVYICGAATGYRSTDRLSDPNWVNYWGQGTQVTVSS

SEQ ID NO: 3079 - protein, 127 aa, Artificial
  Nanobody sequence
QVQLQESGGGLVQAGGSLRLSCAASGRTFGGYAMAWFRQAPGKGREFVAAVTWSSGTTNYAGSVKDRFTVSRDNANNTMYLRMNSLKPEDTAVYICGAASGYRSTDRLSDAAWINYWGQGTQVTVSS

SEQ ID NO: 3080 - protein, 127 aa, Artificial
  Nanobody sequence
QVQLQQSGGGLVQTGGSLRLSCAASGRTFGGYAMAWFREAPGKGREFVAAVTWSSGTTNYAGSVKDRFTVSRDNANNTMYLQMNSLKPEDTAVYICGAASGYRSTDRLSTPEWINYWGQGTQVTVSS

SEQ ID NO: 3081 - protein, 127 aa, Artificial
  Nanobody sequence
QVQLQESGGGLVQTGGSLRLSCAASGRTFGGYAMAWFRQAPGKGREFVAAVTWSSGTTNYAGSVKDRFTVSRDNGNNTMYLQMNSLKPEDTAVYICGVASGYRSTDRLSEPGWINYWGQGTQVTVSS

SEQ ID NO: 3082 - protein, 127 aa, Artificial
  Nanobody sequence
QVQLQESGGGLVQTGGSLRLSCAASGRTFGGYAMAWFRQAPGKGREFVAAITWSAGTTNYADSMKDRFTVSRDTANNTMYLEMNRLKPDDTAVYICGAATGYRSTDRLSTPAWINYWGQGTQVTVSS

SEQ ID NO: 3083 - protein, 127 aa, Artificial
  Nanobody sequence
QVQLQESGGGLVRTGDSLRLSCAASGRTFNGYAMAWFRQAPGKGREFVAAVTWSSGTTNYAGSVKDRFTVSRDNANNTMYLQMNSLKPEDTAVYICGAASGYRSTDRLSDPAWTNYWGQGTQVTVSS

SEQ ID NO: 3084 - protein, 127 aa, Artificial
  Nanobody sequence
QVQLQESGGGLVETGGSLRLSCAASGRTFGGYAMAWFRQAPGKGREFVAAVTWTSGTTNYAGSVKDRFTVSRDNANNTMYLQMNSLKPEDTAVYICGAASGYRSPDRLSEPEWINYWGQGTQVTVSS

SEQ ID NO: 3085 - protein, 127 aa, Artificial
  Nanobody sequence
QVQLQESGGGLVQTGGSLRLSCAASGGTFGGYAMAWFRQAPGKGREFVASVIWNGGTTNYLDSVKDRFTVSRDMANNTMYLQMNSLKPEDTAVYICGAASGYRSTDRLSEPGWVNYWGQGTQVTVSS

SEQ ID NO: 3086 - protein, 127 aa, Artificial
  Nanobody sequence
QVQLQESGGGLVQAGGSLRLSCAASGRTLNNYAMGWFRQAPGAEREFVGAISASGDSTQYTESVQGRFTISKDNAKSTVYLDMNSLKPEDTAVYYCAADRKTLAYYTSRLRSRYDYWGQGTQVTVSS

SEQ ID NO: 3087 - protein, 127 aa, Artificial
  Nanobody sequence
QVQLQQSGGGLVQAGGSLRLSCAASGGTLNNYAMGWFRQAPGAEREFVGAISAGGDSTQYTESVQGRFTISKDNAKSTVYLDMNSLKPEDTAVYYCAADRKTLTYYTSRLRSRYDYWGQGTQVTVSS

SEQ ID NO: 3088 - protein, 127 aa, Artificial
  Nanobody sequence
QVQLQESGGGLVQAGGSLRLSCAASGRTLNNYAMGWFRQAPGAEREFVGAISASGDSTQYTESVQGRFTISKDNAKSTVYLDMNSLKPEDTAVYYCAADRKTLTFYTSRLRSRYDYWGQGTQVTVSS

SEQ ID NO: 3089 - protein, 127 aa, Artificial
  Nanobody sequence
QVQLQQSGGGLVQAGGSLRLSCAASGRTLNNYAMGWFRQAPGAEREFVGAISASGDSTQYTESVQGRFTISKDNAKSTVYLDMNSLKPEDTAVYYCAADRKTLTFYTSRLRSRYDYWGQGTQVTVSS

SEQ ID NO: 3090 - protein, 127 aa, Artificial
  Nanobody sequence
QVQLQESGGGLVQAGGSLRLSCVASGRTLDNYAMGWFRQAPGAEREFVGAISANGEDTQYTESVQGRFTISKDNAKSTVYLDMNSLKPEDTAVYYCAADRKTLTYYTSRLRSRYEYWGQGTQVTVSS

SEQ ID NO: 3091 - protein, 127 aa, Artificial
  Nanobody sequence
QVQLQQSGGGLVQAGGSLRLSCAASGRTLNNYAMGWFRQAPGAEREFVGAISASGDSTQYTESVQGRFTISKDNAKSTVVLDMNSLKPEDTAVYYCAADGKTLTFYTSRLRSRYDYWGQGTQVTVSS

SEQ ID NO: 3092 - protein, 127 aa, Artificial
  Nanobody sequence
QVQLQQSGGGLVQAGGSLRLSCAASGRTLNNYAMGWFRQAPGAEREFVGAISASGDSTQYTESVQGRFSISKDLAKSTVYLDMNSLKPEDTAVYYCAADQKTLTFYTSRLRSRYDYWGQGTQVTVSS

SEQ ID NO: 3093 - protein, 127 aa, Artificial
  Nanobody sequence
QVQLQESGGGLVQAGGSLRLSCAASGRTLNNYAMGWFRQAPGAEREFVGAISASGDSTDYTESVQGRFTISKDNAKSTVYLDMNSLKPEDTAVYYCAADRKTLTFYTSRLRSRYDYWGQGTQVTVSS

SEQ ID NO: 3094 - protein, 127 aa, Artificial
  Nanobody sequence
QVQLQESGGGLVQAGGSLRLSCAASGRTLNNYAMGWFRQAPGAEREFVGAISASGDSTQYTESVQGRFTISKDYAKSTVYLDMNSLKPEDTAVYYCAADQKTLTYYTSRLRSRYDYWGQGTQVTVSS

SEQ ID NO: 3095 - protein, 127 aa, Artificial
  Nanobody sequence
QVQLQESGGGLVQAGGSLRLSCAASGHTLNNYAMGWFRQGPGAEREFVGAISASGDSTQYTESVQGRFTISKDNAKRTVYLDMNSLKPEDTAVYYCAADGKTLTYYTSRLRSQYDYWGQGTQVTVSS

SEQ ID NO: 3096 - protein, 127 aa, Artificial
  Nanobody sequence
QVQLQQSGGGLVQAGESLRLSCAASGRTLNNYAMGWFRQAPGAEREFVGAISASGDSTQYTESVQGRFTISKDNAKSTVYLDMNSLKPEDTAVYYCAADRKTLTFYTSRLRSRYDYWGQGTQVTVSS

SEQ ID NO: 3097 - protein, 123 aa, Artificial
  Nanobody sequence
QVQLQESGGGLVQAGGFLRLSCAASGRSFNTYAMGWFRQAPGKEREFVAGITRSGTATDYADSVKGRFTISRDNARNTVYLQMNRLKSEDSAVYYCAAHASYDRMIYSEYKYWGQGTQVTVSS

SEQ ID NO: 3098 - protein, 123 aa, Artificial
  Nanobody sequence
QVQLQQSGGGLVQAGGFLRLSCAASGRSFNTYAMGWFRQAPGKEREFVAGITRSGTATDYIDSVKGRFTISRDNARDTVYLQMNRLNPEDSAVYYCAAHANYDRMINSEYKYWGQGTQVTVSS

SEQ ID NO: 3099 - protein, 123 aa, Artificial
  Nanobody sequence
QVQLQESGGGLVQAGGFLRLSCAASGRSFNTYAMGWFRQAPGKEREFVAGITRSGTATDYIDSVKGRFTISRDNARDTVYLQMNRLNPEDSAVYYCAAHANYDRMINSEYKYWGQGTQVTVSS

SEQ ID NO: 3100 - protein, 123 aa, Artificial
  Nanobody sequence
QVQLQQSGGGLVQAGGFLRLSCAASGRSFNTYAVGWFRQAPGKEREFVAGITRSGTATDYADSVKGRFTISRDNARNTVYLQMNRLKPEDSAVYYCAAHASYDRMINSEYKYWGQGTQVTVSS

SEQ ID NO: 3101 - protein, 123 aa, Artificial
  Nanobody sequence
QVQLQQSGGGLVQAGGFLRLSCAASGRSFNTYAMGWFRQAPGKEREFVAGITRSGTATEYADSVKGRFTISRDNARNTVLLQMNRLKPEDSAVYYCAAHANYDRMINSEYKYWGQGTQVTVSS

SEQ ID NO: 3102 - protein, 123 aa, Artificial
  Nanobody sequence
QVQLQESGGGLVQAGGFLRLTCAASGRSFNTYAMGWFRQAPGKDRKFVAGITRSGTVTDYADSVKGRFTISRDNARNTVYLQMNRLKPEDSAVYYCAGHASYDRMINSEYKYWGQGTQVTVSS

SEQ ID NO: 3103 - protein, 123 aa, Artificial
  Nanobody sequence
QVQLQESGGGLVQAGGFLRLSCAASGRSFNTYAMGWFRQAPGKEREFVAGITRSGTATDYADSVKGRFTISRDNARNTVYLQMNRLKPEDSAVYYCAAHASYDRMIYSEYKYWGQGTQVTVSS

SEQ ID NO: 3104 - protein, 124 aa, Artificial
  Nanobody sequence
QVQLQESGGGLVQAGDSLRLSCAASGPSFNNGAMSWFRQAPGKEREFVAAIRWSGGGIRYADSVKGRFTISRDNAKNTLYLQMNSLKPEDTAVYYCAIDPRADLVATMTSIRYWGQGTQVTVSS

SEQ ID NO: 3105 - protein, 124 aa, Artificial
  Nanobody sequence
QVQLQESGGGLVQAGDSLRLSCAAPGRSFSGGAMSWFRQVPGKEREFVAAIRWSGGGIRYADSVKGRFTISRDNAKNTFYLQMNSLKPEDTAVYYCAIDPRADLVATMTSIRYWGQGTQVTVSS

SEQ ID NO: 3106 - protein, 124 aa, Artificial
  Nanobody sequence
QVQLQESGGGLVQAGGSLRLSCAASGPSFNNGAMSWFRQAPGKEREFVAAIRWSGGGIRYADSVKGRFTISRDNAKNTLYLQMNSLKPEDTAVYYCAIDPRADLVATMTSIRYWGQGTQVTVSS

SEQ ID NO: 3107 - protein, 124 aa, Artificial
  Nanobody sequence
QVQLQQSGGGLVQAGGSLRLSCAASGRTFSTTGMGWFRQAPGKEREFVAAFWWTGGQTFYADSVKGRFTISGDNAGNTVDLQMNSLKPEDTAVYACAAMSKPRNLWRTDSYDYWGQGTQVTVSS

SEQ ID NO: 3108 - protein, 124 aa, Artificial
  Nanobody sequence
QVQLQESGGGLVQAGGSLRLSCAASGSTFSTYAMGWFRQAPGKEREFVAAFWWTDEQTFYADSVKGRFTISRGNAKNTVDLQMNSLKPEDTAVYACAAMSKPYNLWRTDSYDYWGQGTQVTVSS

SEQ ID NO: 3109 - protein, 122 aa, Artificial
  Nanobody sequence
QVQLQQSGGGLVQSGGSLSLSCAASGITLNNRVVGWFRQAPGKEREFVGRIMWSVGDTFYARSVKGRFTISRDNAKNTMYLQMNALKPEDTAVYYCAAARDPDLYTGQYEYWGQGTQVTVSS

SEQ ID NO: 3110 - protein, 122 aa, Artificial
  Nanobody sequence
QVQLQESGGGLVQPGGSLRLSCSASGFAFDDYAMSWVRQAPGKGLEWVSSINWNGGSTYYAESMKGRFTISRDSAKNTLYLQMNSLKSEDTAVYYCAKGEGSANWGLDFGSWGQGTQVTVSS

SEQ ID NO: 3111 - protein, 30 aa, Artificial
  Framework sequence
QVQLQESGGGLVQPGGSLRLSCTASRTDIS

SEQ ID NO: 3112 - protein, 30 aa, Artificial
  Framework sequence
QVQLQQSGGGLVQPGGSLRLSCAASRSDFA

SEQ ID NO: 3113 - protein, 30 aa, Artificial
  Framework sequence
QVQLQESGGGLVQPGGSLRLSCAASRSGFS

SEQ ID NO: 3114 - protein, 30 aa, Artificial
  Framework sequence
QVQLQESGGGLVQPGGSLRLSCAASRTDIS

SEQ ID NO: 3115 - protein, 30 aa, Artificial
  Framework sequence
QVQLQESGGGLVQPGGSLRLSCAASRSGFV

SEQ ID NO: 3116 - protein, 30 aa, Artificial
  Framework sequence
QVQLQQSGGGLVQAGGSLRLSCAASGSGFS

SEQ ID NO: 3117 - protein, 30 aa, Artificial
  Framework sequence
QVQLQESGGGLVQPGGSLRLSCAASVSGFI

SEQ ID NO: 3118 - protein, 30 aa, Artificial
  Framework sequence
QVQLQQSGGGLVQPGGSLRLSCAASSSGFS

SEQ ID NO: 3119 - protein, 30 aa, Artificial
  Framework sequence
QVQLQESGGGLVQAGGSLRLSCAASGSGFS

SEQ ID NO: 3120 - protein, 30 aa, Artificial
  Framework sequence
QVQLQQSGGGLVQPGGSLRLSCAASRGDIS

SEQ ID NO: 3121 - protein, 30 aa, Artificial; identical to SEQ ID NO: 3113
  Framework sequence

SEQ ID NO: 3122 - protein, 30 aa, Artificial
  Framework sequence
QVQLQESGGGLVQPGGSLRLSCAASRSDFA

SEQ ID NO: 3123 - protein, 30 aa, Artificial
  Framework sequence
QVQLQQSGGGLVQAGGSLRLSCAASGNIIS

SEQ ID NO: 3124 - protein, 30 aa, Artificial
  Framework sequence
QVQLQQSGGGLVQPGGSLRLSCAASRSGFS

SEQ ID NO: 3125 - protein, 30 aa, Artificial
  Framework sequence
QVQLQQSGGGLVQPGGSLRLSCAASRSDIS

SEQ ID NO: 3126 - protein, 30 aa, Artificial
  Framework sequence
QVQLQESGGGLVQPGGSLRLSCAASRSDIS

SEQ ID NO: 3127 - protein, 30 aa, Artificial
  Framework sequence
QVQLQESGGGLVQPGGSLRLSCAASGSIFS

SEQ ID NO: 3128 - protein, 30 aa, Artificial
  Framework sequence
QVQLQQSGGGLVQAGGSLRLSCAASGSAFS

SEQ ID NO: 3129 - protein, 30 aa, Artificial
  Framework sequence
QVQLQQSGGGLVQPGGSLRLSCAASGSTFS

SEQ ID NO: 3130 - protein, 30 aa, Artificial
  Framework sequence
QVQLQQSGGGLVQAGGSLRLSCAASGSSFS

SEQ ID NO: 3131 - protein, 30 aa, Artificial
  Framework sequence
QVQLQESGGGLVQAGGSLRLSCAASGSTFS

SEQ ID NO: 3132 - protein, 30 aa, Artificial
  Framework sequence
QVQLQESGGGLVQAGDSLRLSCAASGRTFN

SEQ ID NO: 3133 - protein, 30 aa, Artificial
  Framework sequence
QVQLQESGGGLVQAGGSLRLSCAFSGDTFS

SEQ ID NO: 3134 - protein, 30 aa, Artificial
  Framework sequence
QVQLQESGGGLVQAGGSLRLSCAASGRPFS

SEQ ID NO: 3135 - protein, 30 aa, Artificial
  Framework sequence
QVQLQESGGGLVQAGGSLRLSCAASGRSLS

SEQ ID NO: 3136 - protein, 30 aa, Artificial
  Framework sequence
QVQLQESGGGLVETGGSLRLSCAASGRTFG

SEQ ID NO: 3137 - protein, 30 aa, Artificial
  Framework sequence
QVQLQESGGGLVQTGGSLRLSCAASGRTFG

SEQ ID NO: 3138 - protein, 30 aa, Artificial; identical to SEQ ID NO: 3137
  Framework sequence

SEQ ID NO: 3139 - protein, 30 aa, Artificial; identical to SEQ ID NO: 3137
  Framework sequence

SEQ ID NO: 3140 - protein, 30 aa, Artificial; identical to SEQ ID NO: 3137
  Framework sequence

SEQ ID NO: 3141 - protein, 30 aa, Artificial
  Framework sequence
QVQLQQSGGGLVQTGGSLRLSCAASGRTFG

SEQ ID NO: 3142 - protein, 30 aa, Artificial; identical to SEQ ID NO: 3137
  Framework sequence

SEQ ID NO: 3143 - protein, 30 aa, Artificial
  Framework sequence
QVQLQESGGGLVQAGGSLRLSCATSGRPFG

SEQ ID NO: 3144 - protein, 30 aa, Artificial
  Framework sequence
QVQLQESGGGLVQAGGSLRLSCAASGRTFG

SEQ ID NO: 3145 - protein, 30 aa, Artificial; identical to SEQ ID NO: 3141
  Framework sequence

SEQ ID NO: 3146 - protein, 30 aa, Artificial; identical to SEQ ID NO: 3137
  Framework sequence

SEQ ID NO: 3147 - protein, 30 aa, Artificial; identical to SEQ ID NO: 3137
  Framework sequence

SEQ ID NO: 3148 - protein, 30 aa, Artificial
  Framework sequence
QVQLQESGGGLVRTGDSLRLSCAASGRTFN

SEQ ID NO: 3149 - protein, 30 aa, Artificial; identical to SEQ ID NO: 3136
  Framework sequence

SEQ ID NO: 3150 - protein, 30 aa, Artificial
  Framework sequence
QVQLQESGGGLVQTGGSLRLSCAASGGTFG

SEQ ID NO: 3151 - protein, 30 aa, Artificial
  Framework sequence
QVQLQESGGGLVQAGGSLRLSCAASGRTLN

SEQ ID NO: 3152 - protein, 30 aa, Artificial
  Framework sequence
QVQLQQSGGGLVQAGGSLRLSCAASGGTLN

SEQ ID NO: 3153 - protein, 30 aa, Artificial; identical to SEQ ID NO: 3151
  Framework sequence

SEQ ID NO: 3154 - protein, 30 aa, Artificial
  Framework sequence
QVQLQQSGGGLVQAGGSLRLSCAASGRTLN

SEQ ID NO: 3155 - protein, 30 aa, Artificial
  Framework sequence
QVQLQESGGGLVQAGGSLRLSCVASGRTLD

SEQ ID NO: 3156 - protein, 30 aa, Artificial; identical to SEQ ID NO: 3154
  Framework sequence

SEQ ID NO: 3157 - protein, 30 aa, Artificial; identical to SEQ ID NO: 3154
  Framework sequence

SEQ ID NO: 3158 - protein, 30 aa, Artificial; identical to SEQ ID NO: 3151
  Framework sequence

SEQ ID NO: 3159 - protein, 30 aa, Artificial; identical to SEQ ID NO: 3151
  Framework sequence

SEQ ID NO: 3160 - protein, 30 aa, Artificial
  Framework sequence
QVQLQESGGGLVQAGGSLRLSCAASGHTLN

SEQ ID NO: 3161 - protein, 30 aa, Artificial
  Framework sequence
QVQLQQSGGGLVQAGESLRLSCAASGRTLN

SEQ ID NO: 3162 - protein, 30 aa, Artificial
  Framework sequence
QVQLQESGGGLVQAGGFLRLSCAASGRSFN

SEQ ID NO: 3163 - protein, 30 aa, Artificial
  Framework sequence
QVQLQQSGGGLVQAGGFLRLSCAASGRSFN

SEQ ID NO: 3164 - protein, 30 aa, Artificial; identical to SEQ ID NO: 3162
  Framework sequence

SEQ ID NO: 3165 - protein, 30 aa, Artificial; identical to SEQ ID NO: 3163
  Framework sequence

SEQ ID NO: 3166 - protein, 30 aa, Artificial; identical to SEQ ID NO: 3163
  Framework sequence

SEQ ID NO: 3167 - protein, 30 aa, Artificial
  Framework sequence
QVQLQESGGGLVQAGGFLRLTCAASGRSFN

SEQ ID NO: 3168 - protein, 30 aa, Artificial; identical to SEQ ID NO: 3162
  Framework sequence

SEQ ID NO: 3169 - protein, 30 aa, Artificial
  Framework sequence
QVQLQESGGGLVQAGDSLRLSCAASGPSFN

SEQ ID NO: 3170 - protein, 30 aa, Artificial
  Framework sequence
QVQLQESGGGLVQAGDSLRLSCAAPGRSFS

SEQ ID NO: 3171 - protein, 30 aa, Artificial
  Framework sequence
QVQLQESGGGLVQAGGSLRLSCAASGPSFN

SEQ ID NO: 3172 - protein, 30 aa, Artificial
  Framework sequence
QVQLQQSGGGLVQAGGSLRLSCAASGRTFS

SEQ ID NO: 3173 - protein, 30 aa, Artificial; identical to SEQ ID NO: 3131
  Framework sequence

SEQ ID NO: 3174 - protein, 30 aa, Artificial
  Framework sequence
QVQLQQSGGGLVQSGGSLSLSCAASGITLN

SEQ ID NO: 3175 - protein, 30 aa, Artificial
  Framework sequence
QVQLQESGGGLVQPGGSLRLSCSASGFAFD

SEQ ID NO: 3176 - protein, 5 aa, Artificial
  CDR1 sequence
FNPMA

SEQ ID NO: 3177 - protein, 5 aa, Artificial
  CDR1 sequence
FNPMG

SEQ ID NO: 3178 - protein, 5 aa, Artificial
  CDR1 sequence
FNPMG

SEQ ID NO: 3179 - protein, 5 aa, Artificial
  CDR1 sequence
FNPMG

SEQ ID NO: 3180 - protein, 5 aa, Artificial
  CDR1 sequence
FNPMG

SEQ ID NO: 3181 - protein, 5 aa, Artificial
  CDR1 sequence
FNPMG

SEQ ID NO: 3182 - protein, 5 aa, Artificial
  CDR1 sequence
FNPMG

SEQ ID NO: 3183 - protein, 5 aa, Artificial
  CDR1 sequence
FNPMG

SEQ ID NO: 3184 - protein, 5 aa, Artificial
  CDR1 sequence
FNPMG

SEQ ID NO: 3185 - protein, 5 aa, Artificial
  CDR1 sequence
FNPMG

SEQ ID NO: 3186 - protein, 5 aa, Artificial
  CDR1 sequence
FNPMG

SEQ ID NO: 3187 - protein, 5 aa, Artificial
  CDR1 sequence
FNPMG

SEQ ID NO: 3188 - protein, 5 aa, Artificial
  CDR1 sequence
FNPMG

SEQ ID NO: 3189 - protein, 5 aa, Artificial
  CDR1 sequence
FNPMG

SEQ ID NO: 3190 - protein, 5 aa, Artificial
  CDR1 sequence
FNPMG

SEQ ID NO: 3191 - protein, 5 aa, Artificial
  CDR1 sequence
FNPMG

SEQ ID NO: 3192 - protein, 5 aa, Artificial
  CDR1 sequence
INRMG

SEQ ID NO: 3193 - protein, 5 aa, Artificial
  CDR1 sequence
INTMG

SEQ ID NO: 3194 - protein, 5 aa, Artificial
  CDR1 sequence
INAMG

SEQ ID NO: 3195 - protein, 5 aa, Artificial
  CDR1 sequence
INAMG

SEQ ID NO: 3196 - protein, 5 aa, Artificial
  CDR1 sequence
INAMG

SEQ ID NO: 3197 - protein, 5 aa, Artificial
  CDR1 sequence
SLTMA

SEQ ID NO: 3198 - protein, 5 aa, Artificial
  CDR1 sequence
FYTLG

SEQ ID NO: 3199 - protein, 5 aa, Artificial
  CDR1 sequence
SAAMG

SEQ ID NO: 3200 - protein, 5 aa, Artificial
  CDR1 sequence
RYAMG

SEQ ID NO: 3201 - protein, 5 aa, Artificial
  CDR1 sequence
GYALA

SEQ ID NO: 3202 - protein, 5 aa, Artificial
  CDR1 sequence
GYAMA

SEQ ID NO: 3203 - protein, 5 aa, Artificial
  CDR1 sequence
GYAMA

SEQ ID NO: 3204 - protein, 5 aa, Artificial
  CDR1 sequence
GYAMA

SEQ ID NO: 3205 - protein, 5 aa, Artificial
  CDR1 sequence
GYAMA

SEQ ID NO: 3206 - protein, 5 aa, Artificial
  CDR1 sequence
GYAMA

SEQ ID NO: 3207 - protein, 5 aa, Artificial
  CDR1 sequence
GYAMA

SEQ ID NO: 3208 - protein, 5 aa, Artificial
  CDR1 sequence
GYAMA

SEQ ID NO: 3209 - protein, 5 aa, Artificial
  CDR1 sequence
GYAMA

SEQ ID NO: 3210 - protein, 5 aa, Artificial
  CDR1 sequence
GYAMA

SEQ ID NO: 3211 - protein, 5 aa, Artificial
  CDR1 sequence
GYAMA

SEQ ID NO: 3212 - protein, 5 aa, Artificial
  CDR1 sequence
GYAMA

SEQ ID NO: 3213 - protein, 5 aa, Artificial
  CDR1 sequence
GYAMA

SEQ ID NO: 3214 - protein, 5 aa, Artificial
  CDR1 sequence
GYAMA

SEQ ID NO: 3215 - protein, 5 aa, Artificial
  CDR1 sequence
GYAMA

SEQ ID NO: 3216 - protein, 5 aa, Artificial
  CDR1 sequence
NYAMG

SEQ ID NO: 3217 - protein, 5 aa, Artificial
  CDR1 sequence
NYAMG

SEQ ID NO: 3218 - protein, 5 aa, Artificial
  CDR1 sequence
NYAMG

SEQ ID NO: 3219 - protein, 5 aa, Artificial
  CDR1 sequence
NYAMG

SEQ ID NO: 3220 - protein, 5 aa, Artificial
  CDR1 sequence
NYAMG

SEQ ID NO: 3221 - protein, 5 aa, Artificial
  CDR1 sequence
NYAMG

SEQ ID NO: 3222 - protein, 5 aa, Artificial
  CDR1 sequence
NYAMG

SEQ ID NO: 3223 - protein, 5 aa, Artificial
  CDR1 sequence
NYAMG

SEQ ID NO: 3224 - protein, 5 aa, Artificial
  CDR1 sequence
NYAMG

SEQ ID NO: 3225 - protein, 5 aa, Artificial
  CDR1 sequence
NYAMG

SEQ ID NO: 3226 - protein, 5 aa, Artificial
  CDR1 sequence
NYAMG

SEQ ID NO: 3227 - protein, 5 aa, Artificial
  CDR1 sequence
TYAMG

SEQ ID NO: 3228 - protein, 5 aa, Artificial
  CDR1 sequence
TYAMG

SEQ ID NO: 3229 - protein, 5 aa, Artificial
  CDR1 sequence
TYAMG

SEQ ID NO: 3230 - protein, 5 aa, Artificial
  CDR1 sequence
TYAVG

SEQ ID NO: 3231 - protein, 5 aa, Artificial
  CDR1 sequence
TYAMG

SEQ ID NO: 3232 - protein, 5 aa, Artificial
  CDR1 sequence
TYAMG

SEQ ID NO: 3233 - protein, 5 aa, Artificial
  CDR1 sequence
TYAMG

SEQ ID NO: 3234 - protein, 5 aa, Artificial
  CDR1 sequence
NGAMS

SEQ ID NO: 3235 - protein, 5 aa, Artificial
  CDR1 sequence
GGAMS

SEQ ID NO: 3236 - protein, 5 aa, Artificial
  CDR1 sequence
NGAMS

SEQ ID NO: 3237 - protein, 5 aa, Artificial
  CDR1 sequence
TTGMG

SEQ ID NO: 3238 - protein, 5 aa, Artificial
  CDR1 sequence
TYAMG

SEQ ID NO: 3239 - protein, 5 aa, Artificial
  CDR1 sequence
NRVVG

SEQ ID NO: 3240 - protein, 5 aa, Artificial
  CDR1 sequence
DYAMS

SEQ ID NO: 3241 - protein, 14 aa, Artificial
  Framework sequence
WYRQAPGQQRELVA

SEQ ID NO: 3242 - protein, 14 aa, Artificial
  Framework sequence
WYRQAPGKQRELVA

SEQ ID NO: 3243 - protein, 14 aa, Artificial
  Framework sequence
WYRQAPGKQRELVA

SEQ ID NO: 3244 - protein, 14 aa, Artificial
  Framework sequence
WYRQAPGKQRELVA

SEQ ID NO: 3245 - protein, 14 aa, Artificial
  Framework sequence
WYRQAPGKQRELVA

SEQ ID NO: 3246 - protein, 14 aa, Artificial
  Framework sequence
WYRQAPGKQRELVA

SEQ ID NO: 3247 - protein, 14 aa, Artificial
  Framework sequence
WYRQARGKQREEVA

SEQ ID NO: 3248 - protein, 14 aa, Artificial
  Framework sequence
WYRQAPGKQRELVA

SEQ ID NO: 3249 - protein, 14 aa, Artificial
  Framework sequence
WYRQAPGKQRELVA

SEQ ID NO: 3250 - protein, 14 aa, Artificial
  Framework sequence
WYRQAPGKQRELVA

SEQ ID NO: 3251 - protein, 14 aa, Artificial
  Framework sequence
WYRQAPGKQRELVA

SEQ ID NO: 3252 - protein, 14 aa, Artificial
  Framework sequence
WYRQAPGKQRELVA

SEQ ID NO: 3253 - protein, 14 aa, Artificial
  Framework sequence
WHRQAPGKQRELVA

SEQ ID NO: 3254 - protein, 14 aa, Artificial
  Framework sequence
WYRQAPGKQRELVA

SEQ ID NO: 3255 - protein, 14 aa, Artificial
  Framework sequence
WYRQAPGKQRELVA

SEQ ID NO: 3256 - protein, 14 aa, Artificial
  Framework sequence
WYRQAPGKQRELVA

SEQ ID NO: 3257 - protein, 14 aa, Artificial
  Framework sequence
WYRQAPGKQRELVA

SEQ ID NO: 3258 - protein, 14 aa, Artificial
  Framework sequence
WYRQAPGKQRELVA

SEQ ID NO: 3259 - protein, 14 aa, Artificial
  Framework sequence
WYRQAPGKQRELVA

SEQ ID NO: 3260 - protein, 14 aa, Artificial
  Framework sequence
WYRQAPGKQRELVA

SEQ ID NO: 3261 - protein, 14 aa, Artificial
  Framework sequence
WYRQAPGKQRELVA

SEQ ID NO: 3262 - protein, 14 aa, Artificial
  Framework sequence
WFRQAPGKDRDFVS

SEQ ID NO: 3263 - protein, 14 aa, Artificial
  Framework sequence
WFRQAPGKEREFVA

SEQ ID NO: 3264 - protein, 14 aa, Artificial
  Framework sequence
WFRQAPGKEREFVS

SEQ ID NO: 3265 - protein, 14 aa, Artificial
  Framework sequence
WFRQAPGKEREFVA

SEQ ID NO: 3266 - protein, 14 aa, Artificial
  Framework sequence
WFRQAPGKGREFVA

SEQ ID NO: 3267 - protein, 14 aa, Artificial
  Framework sequence
WFRQAPRKGREFVA

SEQ ID NO: 3268 - protein, 14 aa, Artificial
  Framework sequence
WFRQVPGKGREFVA

SEQ ID NO: 3269 - protein, 14 aa, Artificial
  Framework sequence
WFRQAPGKGREFVA

SEQ ID NO: 3270 - protein, 14 aa, Artificial
  Framework sequence
WFRQAPGKGREFVA

SEQ ID NO: 3271 - protein, 14 aa, Artificial
  Framework sequence
WFRQAPGKGREFVA

SEQ ID NO: 3272 - protein, 14 aa, Artificial
  Framework sequence
WFRQAPGKGREFVA

SEQ ID NO: 3273 - protein, 14 aa, Artificial
  Framework sequence
WFRQAPGKGREFVA

SEQ ID NO: 3274 - protein, 14 aa, Artificial
  Framework sequence
WFRQAPGKGREFVA

SEQ ID NO: 3275 - protein, 14 aa, Artificial
  Framework sequence
WFREAPGKGREFVA

SEQ ID NO: 3276 - protein, 14 aa, Artificial
  Framework sequence
WFRQAPGKGREFVA

SEQ ID NO: 3277 - protein, 14 aa, Artificial
  Framework sequence
WFRQAPGKGREFVA

SEQ ID NO: 3278 - protein, 14 aa, Artificial
  Framework sequence
WFRQAPGKGREFVA

SEQ ID NO: 3279 - protein, 14 aa, Artificial
  Framework sequence
WFRQAPGKGREFVA

SEQ ID NO: 3280 - protein, 14 aa, Artificial
  Framework sequence
WFRQAPGKGREFVA

SEQ ID NO: 3281 - protein, 14 aa, Artificial
  Framework sequence
WFRQAPGAEREFVG

SEQ ID NO: 3282 - protein, 14 aa, Artificial
  Framework sequence
WFRQAPGAEREFVG

SEQ ID NO: 3283 - protein, 14 aa, Artificial
  Framework sequence
WFRQAPGAEREFVG

SEQ ID NO: 3284 - protein, 14 aa, Artificial
  Framework sequence
WFRQAPGAEREFVG

SEQ ID NO: 3285 - protein, 14 aa, Artificial
  Framework sequence
WFRQAPGAEREFVG

SEQ ID NO: 3286 - protein, 14 aa, Artificial
  Framework sequence
WFRQAPGAEREFVG

SEQ ID NO: 3287 - protein, 14 aa, Artificial
  Framework sequence
WFRQAPGAEREFVG

SEQ ID NO: 3288 - protein, 14 aa, Artificial
  Framework sequence
WFRQAPGAEREFVG

SEQ ID NO: 3289 - protein, 14 aa, Artificial
  Framework sequence
WFRQAPGAEREFVG

SEQ ID NO: 3290 - protein, 14 aa, Artificial
  Framework sequence
WFRQGPGAEREFVG

SEQ ID NO: 3291 - protein, 14 aa, Artificial
  Framework sequence
WFRQAPGAEREFVG

SEQ ID NO: 3292 - protein, 14 aa, Artificial
  Framework sequence
WFRQAPGKEREFVA

SEQ ID NO: 3293 - protein, 14 aa, Artificial
  Framework sequence
WFRQAPGKEREFVA

SEQ ID NO: 3294 - protein, 14 aa, Artificial
  Framework sequence
WFRQAPGKEREFVA

SEQ ID NO: 3295 - protein, 14 aa, Artificial
  Framework sequence
WFRQAPGKEREFVA

SEQ ID NO: 3296 - protein, 14 aa, Artificial
  Framework sequence
WFRQAPGKEREFVA

SEQ ID NO: 3297 - protein, 14 aa, Artificial
  Framework sequence
WFRQAPGKDRKFVA

SEQ ID NO: 3298 - protein, 14 aa, Artificial
  Framework sequence
WFRQAPGKEREFVA

SEQ ID NO: 3299 - protein, 14 aa, Artificial
  Framework sequence
WFRQAPGKEREFVA

SEQ ID NO: 3300 - protein, 14 aa, Artificial
  Framework sequence
WFRQVPGKEREFVA

SEQ ID NO: 3301 - protein, 14 aa, Artificial
  Framework sequence
WFRQAPGKEREFVA

SEQ ID NO: 3302 - protein, 14 aa, Artificial
  Framework sequence
WFRQAPGKEREFVA

SEQ ID NO: 3303 - protein, 14 aa, Artificial
  Framework sequence
WFRQAPGKEREFVA

SEQ ID NO: 3304 - protein, 14 aa, Artificial
  Framework sequence
WFRQAPGKEREFVG

SEQ ID NO: 3305 - protein, 14 aa, Artificial
  Framework sequence
WVRQAPGKGLEWVS

SEQ ID NO: 3306 - protein, 16 aa, Artificial
  CDR2 sequence
SITSGGTTNYANSVKG

SEQ ID NO: 3307 - protein, 16 aa, Artificial
  CDR2 sequence
VLTTGGTTNYADSVKG

SEQ ID NO: 3308 - protein, 16 aa, Artificial
  CDR2 sequence
TITSGGTTNYADSVKG

SEQ ID NO: 3309 - protein, 16 aa, Artificial
  CDR2 sequence
TMTSGGTTGYADSVKG

SEQ ID NO: 3310 - protein, 16 aa, Artificial
  CDR2 sequence
VITASLTTNYADSVKG

SEQ ID NO: 3311 - protein, 16 aa, Artificial
  CDR2 sequence
SITSGGTTNYVDSVKG

SEQ ID NO: 3312 - protein, 16 aa, Artificial
  CDR2 sequence
VLTTGGTTKYADSVKD

SEQ ID NO: 3313 - protein, 16 aa, Artificial
  CDR2 sequence
TMTSGGTTNYADSVKG

SEQ ID NO: 3314 - protein, 16 aa, Artificial
  CDR2 sequence
SITSGGTTNYVDSVKG

SEQ ID NO: 3315 - protein, 16 aa, Artificial
  CDR2 sequence
TITNGGTTNYADSVKG

SEQ ID NO: 3316 - protein, 16 aa, Artificial
  CDR2 sequence
TITSGGTTNYADSVKG

SEQ ID NO: 3317 - protein, 16 aa, Artificial
  CDR2 sequence
VLTTGGTTNYADSVKG

SEQ ID NO: 3318 - protein, 16 aa, Artificial
  CDR2 sequence
SITSGGSISYVDSVKG

SEQ ID NO: 3319 - protein, 16 aa, Artificial
  CDR2 sequence
TITSGGTTNYADSVKG

SEQ ID NO: 3320 - protein, 16 aa, Artificial
  CDR2 sequence
TISNGGTTNYADSVKG

SEQ ID NO: 3321 - protein, 16 aa, Artificial
  CDR2 sequence
TISNGGTTNYADSVKG

SEQ ID NO: 3322 - protein, 16 aa, Artificial
  CDR2 sequence
AITYGGSTNYADSVKG

SEQ ID NO: 3323 - protein, 18 aa, Artificial
  CDR2 sequence
VISSGSGGSTNYADSVKG

SEQ ID NO: 3324 - protein, 16 aa, Artificial
  CDR2 sequence
AISSGGSTNYADSVKG

SEQ ID NO: 3325 - protein, 16 aa, Artificial
  CDR2 sequence
AISSGGSANYADSVKG

SEQ ID NO: 3326 - protein, 16 aa, Artificial
  CDR2 sequence
AISSGGSTNYADSVKG

SEQ ID NO: 3327 - protein, 17 aa, Artificial
  CDR2 sequence
VVNWDGDRTNYADSVKG

SEQ ID NO: 3328 - protein, 17 aa, Artificial
  CDR2 sequence
ATSNIGGYIYYGDSVKG

SEQ ID NO: 3329 - protein, 17 aa, Artificial
  CDR2 sequence
AISYTGDVTRYADSVKG

SEQ ID NO: 3330 - protein, 16 aa, Artificial
  CDR2 sequence
TKTSGGVTYYGASVKG

SEQ ID NO: 3331 - protein, 17 aa, Artificial
  CDR2 sequence
AVTWTSGTTNYAGSVKD

SEQ ID NO: 3332 - protein, 17 aa, Artificial
  CDR2 sequence
SVTWNGGATDYAGSVKD

SEQ ID NO: 3333 - protein, 17 aa, Artificial
  CDR2 sequence
AVTWSSGTTNYARSVKD

SEQ ID NO: 3334 - protein, 17 aa, Artificial
  CDR2 sequence
AVTWSSGTTNYAGSVKD

SEQ ID NO: 3335 - protein, 17 aa, Artificial
  CDR2 sequence
AVTWSAGTTNYAGSVKD

SEQ ID NO: 3336 - protein, 17 aa, Artificial
  CDR2 sequence
AVTWSAGTTNYAGSVKD

SEQ ID NO: 3337 - protein, 17 aa, Artificial
  CDR2 sequence
AVTWSAGTTNYAGSVKD

SEQ ID NO: 3338 - protein, 17 aa, Artificial
  CDR2 sequence
AVTWSAGTTNYAGSVKD

SEQ ID NO: 3339 - protein, 17 aa, Artificial
  CDR2 sequence
AVTWSSGTTNYAGSVKD

SEQ ID NO: 3340 - protein, 17 aa, Artificial
  CDR2 sequence
AVTWSSGTTNYAGSVKD

SEQ ID NO: 3341 - protein, 17 aa, Artificial
  CDR2 sequence
AVTWSSGTTNYAGSVKD

SEQ ID NO: 3342 - protein, 17 aa, Artificial
  CDR2 sequence
AITWSAGTTNYADSMKD

SEQ ID NO: 3343 - protein, 17 aa, Artificial
  CDR2 sequence
AVTWSSGTTNYAGSVKD

SEQ ID NO: 3344 - protein, 17 aa, Artificial
  CDR2 sequence
AVTWTSGTTNYAGSVKD

SEQ ID NO: 3345 - protein, 17 aa, Artificial
  CDR2 sequence
SVIWNGGTTNYLDSVKD

SEQ ID NO: 3346 - protein, 17 aa, Artificial
  CDR2 sequence
AISASGDSTQYTESVQG

SEQ ID NO: 3347 - protein, 17 aa, Artificial
  CDR2 sequence
AISAGGDSTQYTESVQG

SEQ ID NO: 3348 - protein, 17 aa, Artificial
  CDR2 sequence
AISASGDSTQYTESVQG

SEQ ID NO: 3349 - protein, 17 aa, Artificial
  CDR2 sequence
AISASGDSTQYTESVQG

SEQ ID NO: 3350 - protein, 17 aa, Artificial
  CDR2 sequence
AISANGEDTQYTESVQG

SEQ ID NO: 3351 - protein, 17 aa, Artificial
  CDR2 sequence
AISASGDSTQYTESVQG

SEQ ID NO: 3352 - protein, 17 aa, Artificial
  CDR2 sequence
AISASGDSTQYTESVQG

SEQ ID NO: 3353 - protein, 17 aa, Artificial
  CDR2 sequence
AISASGDSTDYTESVQG

SEQ ID NO: 3354 - protein, 17 aa, Artificial
  CDR2 sequence
AISASGDSTQYTESVQG

SEQ ID NO: 3355 - protein, 17 aa, Artificial
  CDR2 sequence
AISASGDSTQYTESVQG

SEQ ID NO: 3356 - protein, 17 aa, Artificial
  CDR2 sequence
AISASGDSTQYTESVQG

SEQ ID NO: 3357 - protein, 17 aa, Artificial
  CDR2 sequence
GITRSGTATDYADSVKG

SEQ ID NO: 3358 - protein, 17 aa, Artificial
  CDR2 sequence
GITRSGTATDYIDSVKG

SEQ ID NO: 3359 - protein, 17 aa, Artificial
  CDR2 sequence
GITRSGTATDYIDSVKG

SEQ ID NO: 3360 - protein, 17 aa, Artificial
  CDR2 sequence
GITRSGTATDYADSVKG

SEQ ID NO: 3361 - protein, 17 aa, Artificial
  CDR2 sequence
GITRSGTATEYADSVKG

SEQ ID NO: 3362 - protein, 17 aa, Artificial
  CDR2 sequence
GITRSGTVTDYADSVKG

SEQ ID NO: 3363 - protein, 17 aa, Artificial
  CDR2 sequence
GITRSGTATDYADSVKG

SEQ ID NO: 3364 - protein, 17 aa, Artificial
  CDR2 sequence
AIRWSGGGIRYADSVKG

SEQ ID NO: 3365 - protein, 17 aa, Artificial
  CDR2 sequence
AIRWSGGGIRYADSVKG

SEQ ID NO: 3366 - protein, 17 aa, Artificial
  CDR2 sequence
AIRWSGGGIRYADSVKG

SEQ ID NO: 3367 - protein, 17 aa, Artificial
  CDR2 sequence
AFWWTGGQTFYADSVKG

SEQ ID NO: 3368 - protein, 17 aa, Artificial
  CDR2 sequence
AFWWTDEQTFYADSVKG

SEQ ID NO: 3369 - protein, 17 aa, Artificial
  CDR2 sequence
RIMWSVGDTFYARSVKG

SEQ ID NO: 3370 - protein, 17 aa, Artificial
  CDR2 sequence
SINWNGGSTYYAESMKG

SEQ ID NO: 3371 - protein, 32 aa, Artificial
  Framework sequence
RFTISRDNPKNTMYLQMNSLKPEDTAVYYCNG

SEQ ID NO: 3372 - protein, 32 aa, Artificial
  Framework sequence
RFTISRDNARNTVYLQMNSLKPEDTAVYYCYA

SEQ ID NO: 3373 - protein, 32 aa, Artificial
  Framework sequence
RFTISTDNAKTTVFLQMNSLKPEDTAVYYCNA

SEQ ID NO: 3374 - protein, 32 aa, Artificial
  Framework sequence
RFTISRDNPKNTLYLQMNSLEPEDTAVYYCHA

SEQ ID NO: 3375 - protein, 32 aa, Artificial
  Framework sequence
RFTISRDNTGNTAYLQMNSLKPEDTAVYYCYG

SEQ ID NO: 3376 - protein, 32 aa, Artificial
  Framework sequence
RFTISRGNAKNTVYLQMNSLKPEDTAVYYCAA

SEQ ID NO: 3377 - protein, 32 aa, Artificial
  Framework sequence
RFTISRDNARNTVDLQMNSLKPEDTAVYYCYA

SEQ ID NO: 3378 - protein, 32 aa, Artificial
  Framework sequence
RFTISRDNAKTTVYLQMNSLKPEDTAVYYCNA

SEQ ID NO: 3379 - protein, 32 aa, Artificial; identical to SEQ ID NO: 3376
  Framework sequence

SEQ ID NO: 3380 - protein, 32 aa, Artificial
  Framework sequence
RFTISRDNAETAVYLQMNSLKPEDTAVYYCNA

SEQ ID NO: 3381 - protein, 32 aa, Artificial
  Framework sequence
RFTISTDNAKTTVYLQMNSLKPEDTAVYYCNG

SEQ ID NO: 3382 - protein, 32 aa, Artificial; identical to SEQ ID NO: 3372
  Framework sequence

SEQ ID NO: 3383 - protein, 32 aa, Artificial
  Framework sequence
RFTISRDSAKNTIYLQMNSLKPEDTAVYFCAG

SEQ ID NO: 3384 - protein, 32 aa, Artificial
  Framework sequence
RFTISTDNAKTTVFLQMNSLKPEDTAVYYCNG

SEQ ID NO: 3385 - protein, 32 aa, Artificial
  Framework sequence
RFTISQDNAKTTVYLQMNSLKPEDTAVYYCNG

SEQ ID NO: 3386 - protein, 32 aa, Artificial; identical to SEQ ID NO: 3385
  Framework sequence

SEQ ID NO: 3387 - protein, 32 aa, Artificial; identical to SEQ ID NO: 1605
  Framework sequence

SEQ ID NO: 3388 - protein, 32 aa, Artificial
  Framework sequence
RFTISRDNAKNTVYLHMNSLKPEDTAVYYCNA

SEQ ID NO: 3389 - protein, 32 aa, Artificial; identical to SEQ ID NO: 1605
  Framework sequence

SEQ ID NO: 3390 - protein, 32 aa, Artificial; identical to SEQ ID NO: 1605
  Framework sequence

SEQ ID NO: 3391 - protein, 32 aa, Artificial; identical to SEQ ID NO: 1605
  Framework sequence

SEQ ID NO: 3392 - protein, 32 aa, Artificial
  Framework sequence
RFTIFRDNAKNTVYLQMNGLKPDDTAIYRCAA

SEQ ID NO: 3393 - protein, 32 aa, Artificial
  Framework sequence
RFTISGDNAKNTVYLQMSSLKPEDTAVYYCAA

SEQ ID NO: 3394 - protein, 32 aa, Artificial
  Framework sequence
RFTISRDNTRNTLTLEMNSLKPEDTAVYYCAA

SEQ ID NO: 3395 - protein, 32 aa, Artificial
  Framework sequence
RFTISRDNAKNMVYLQMNSLNPEDTAIYYCAA

SEQ ID NO: 3396 - protein, 32 aa, Artificial
  Framework sequence
RFTVSRDNAGNTMYLQMNSLRPEDTAVYICGA

SEQ ID NO: 3397 - protein, 32 aa, Artificial
  Framework sequence
RFTVSRDTANNTMYLQMNSLKPEDTAVYICGA

SEQ ID NO: 3398 - protein, 32 aa, Artificial
  Framework sequence
RFIVSRDNANNTMYLQMNSLKPEDTAVYICGA

SEQ ID NO: 3399 - protein, 32 aa, Artificial
  Framework sequence
RFTVSRDNANNTMYLQMNSLKPEDTAVYICGA

SEQ ID NO: 3400 - protein, 32 aa, Artificial; identical to SEQ ID NO: 3399
  Framework sequence

SEQ ID NO: 3401 - protein, 32 aa, Artificial; identical to SEQ ID NO: 3399
  Framework sequence

SEQ ID NO: 3402 - protein, 32 aa, Artificial; identical to SEQ ID NO: 3399
  Framework sequence

SEQ ID NO: 3403 - protein, 32 aa, Artificial; identical to SEQ ID NO: 3399
  Framework sequence

SEQ ID NO: 3404 - protein, 32 aa, Artificial
  Framework sequence
RFTVSRDNANNTMYLRMNSLKPEDTAVYICGA

SEQ ID NO: 3405 - protein, 32 aa, Artificial; identical to SEQ ID NO: 3399
  Framework sequence

SEQ ID NO: 3406 - protein, 32 aa, Artificial
  Framework sequence
RFTVSRDNGNNTMYLQMNSLKPEDTAVYICGV

SEQ ID NO: 3407 - protein, 32 aa, Artificial
  Framework sequence
RFTVSRDTANNTMYLEMNRLKPDDTAVYICGA

SEQ ID NO: 3408 - protein, 32 aa, Artificial; identical to SEQ ID NO: 3399
  Framework sequence

SEQ ID NO: 3409 - protein, 32 aa, Artificial; identical to SEQ ID NO: 3399
  Framework sequence

SEQ ID NO: 3410 - protein, 32 aa, Artificial
  Framework sequence
RFTVSRDMANNTMYLQMNSLKPEDTAVYICGA

SEQ ID NO: 3411 - protein, 32 aa, Artificial
  Framework sequence
RFTISKDNAKSTVYLDMNSLKPEDTAVYYCAA

SEQ ID NO: 3412 - protein, 32 aa, Artificial; identical to SEQ ID NO: 3411
  Framework sequence

SEQ ID NO: 3413 - protein, 32 aa, Artificial; identical to SEQ ID NO: 3411
  Framework sequence

SEQ ID NO: 3414 - protein, 32 aa, Artificial; identical to SEQ ID NO: 3411
  Framework sequence

SEQ ID NO: 3415 - protein, 32 aa, Artificial; identical to SEQ ID NO: 3411
  Framework sequence

SEQ ID NO: 3416 - protein, 32 aa, Artificial
  Framework sequence
RFTISKDNAKSTVVLDMNSLKPEDTAVYYCAA

SEQ ID NO: 3417 - protein, 32 aa, Artificial
  Framework sequence
RFSISKDLAKSTVYLDMNSLKPEDTAVYYCAA

SEQ ID NO: 3418 - protein, 32 aa, Artificial; identical to SEQ ID NO: 3411
  Framework sequence

SEQ ID NO: 3419 - protein, 32 aa, Artificial
  Framework sequence
RFTISKDYAKSTVYLDMNSLKPEDTAVYYCAA

SEQ ID NO: 3420 - protein, 32 aa, Artificial
  Framework sequence
RFTISKDNAKRTVYLDMNSLKPEDTAVYYCAA

SEQ ID NO: 3421 - protein, 32 aa, Artificial; identical to SEQ ID NO: 3411
  Framework sequence

SEQ ID NO: 3422 - protein, 32 aa, Artificial
  Framework sequence
RFTISRDNARNTVYLQMNRLKSEDSAVYYCAA

SEQ ID NO: 3423 - protein, 32 aa, Artificial
  Framework sequence
RFTISRDNARDTVYLQMNRLNPEDSAVYYCAA

SEQ ID NO: 3424 - protein, 32 aa, Artificial; identical to SEQ ID NO: 3423
  Framework sequence

SEQ ID NO: 3425 - protein, 32 aa, Artificial
  Framework sequence
RFTISRDNARNTVYLQMNRLKPEDSAVYYCAA

SEQ ID NO: 3426 - protein, 32 aa, Artificial
  Framework sequence
RFTISRDNARNTVLLQMNRLKPEDSAVYYCAA

SEQ ID NO: 3427 - protein, 32 aa, Artificial
  Framework sequence
RFTISRDNARNTVYLQMNRLKPEDSAVYYCAG

SEQ ID NO: 3428 - protein, 32 aa, Artificial; identical to SEQ ID NO: 3425
  Framework sequence

SEQ ID NO: 3429 - protein, 32 aa, Artificial
  Framework sequence
RFTISRDNAKNTLYLQMNSLKPEDTAVYYCAI

SEQ ID NO: 3430 - protein, 32 aa, Artificial
  Framework sequence
RFTISRDNAKNTFYLQMNSLKPEDTAVYYCAI

SEQ ID NO: 3431 - protein, 32 aa, Artificial; identical to SEQ ID NO: 3429
  Framework sequence

SEQ ID NO: 3432 - protein, 32 aa, Artificial
  Framework sequence
RFTISGDNAGNTVDLQMNSLKPEDTAVYACAA

SEQ ID NO: 3433 - protein, 32 aa, Artificial
  Framework sequence
RFTISRGNAKNTVDLQMNSLKPEDTAVYACAA

SEQ ID NO: 3434 - protein, 32 aa, Artificial
  Framework sequence
RFTISRDNAKNTMYLQMNALKPEDTAVYYCAA

SEQ ID NO: 3435 - protein, 32 aa, Artificial
  Framework sequence
RFTISRDSAKNTLYLQMNSLKSEDTAVYYCAK

SEQ ID NO: 3436 - protein, 15 aa, Artificial
  CDR3 sequence
RGPRYTTTGWITDDY

SEQ ID NO: 3437 - protein, 15 aa, Artificial
  CDR3 sequence
RGPRKAPTGWITDDY

SEQ ID NO: 3438 - protein, 15 aa, Artificial
  CDR3 sequence
RGPRRGTAGWITDDY

SEQ ID NO: 3439 - protein, 15 aa, Artificial
  CDR3 sequence
RGPRYATTGWFTDDY

SEQ ID NO: 3440 - protein, 15 aa, Artificial
  CDR3 sequence
RGPRKAPTGWITDDY

SEQ ID NO: 3441 - protein, 15 aa, Artificial
  CDR3 sequence
EGPRRRGSTWYTDNY

SEQ ID NO: 3442 - protein, 15 aa, Artificial
  CDR3 sequence
RGPRHVPTGWITDDY

SEQ ID NO: 3443 - protein, 15 aa, Artificial
  CDR3 sequence
RGPRRATTGWITDDY

SEQ ID NO: 3444 - protein, 15 aa, Artificial
  CDR3 sequence
EGPRRRGSTWYTDNY

SEQ ID NO: 3445 - protein, 15 aa, Artificial
  CDR3 sequence
RGPRHATTGWYTDDY

SEQ ID NO: 3446 - protein, 15 aa, Artificial
  CDR3 sequence
RGPRRATTGWITDDY

SEQ ID NO: 3447 - protein, 15 aa, Artificial
  CDR3 sequence
RGPRKAPTGWITDDY

SEQ ID NO: 3448 - protein, 15 aa, Artificial
  CDR3 sequence
EGPRRRGSTWYTDTY

SEQ ID NO: 3449 - protein, 15 aa, Artificial
  CDR3 sequence
RGPRRGTAGWFTDDY

SEQ ID NO: 3450 - protein, 15 aa, Artificial
  CDR3 sequence
RGPRYATTGWYTDDY

SEQ ID NO: 3451 - protein, 15 aa, Artificial
  CDR3 sequence
RGPRYATTGWYTDDY

SEQ ID NO: 3452 - protein, 13 aa, Artificial
  CDR3 sequence
GSTYSPFGDKYDY

SEQ ID NO: 3453 - protein, 13 aa, Artificial
  CDR3 sequence
GSRFNPFGSAYDY

SEQ ID NO: 3454 - protein, 13 aa, Artificial
  CDR3 sequence
GSRFNPFGSAYDY

SEQ ID NO: 3455 - protein, 13 aa, Artificial
  CDR3 sequence
GSRFNPFGSAYDY

SEQ ID NO: 3456 - protein, 13 aa, Artificial
  CDR3 sequence
GSRFNPFGSAYDY

SEQ ID NO: 3457 - protein, 16 aa, Artificial
  CDR3 sequence
RWDYGLWRPSTYNYAY

SEQ ID NO: 3458 - protein, 19 aa, Artificial
  CDR3 sequence
TLRSGSMWYQNVRVNDNPY

SEQ ID NO: 3459 - protein, 15 aa, Artificial
  CDR3 sequence
RTYAGVRAHTYDYDY

SEQ ID NO: 3460 - protein, 14 aa, Artificial
  CDR3 sequence
GTDAIFKPWMLPDY

SEQ ID NO: 3461 - protein, 18 aa, Artificial
  CDR3 sequence
ASGYRSPDRLSEPNWVNY

SEQ ID NO: 3462 - protein, 18 aa, Artificial
  CDR3 sequence
ASGYRSTDRLSDPGWTNY

SEQ ID NO: 3463 - protein, 18 aa, Artificial
  CDR3 sequence
ASGYRSTDRLSEPAWINY

SEQ ID NO: 3464 - protein, 18 aa, Artificial
  CDR3 sequence
ASGYRSTDRLSTPEWINY

SEQ ID NO: 3465 - protein, 18 aa, Artificial
  CDR3 sequence
ATGYRSTDRLAEPGWVNY

SEQ ID NO: 3466 - protein, 18 aa, Artificial
  CDR3 sequence
ASGYRSTDRLSEPAWINY

SEQ ID NO: 3467 - protein, 18 aa, Artificial
  CDR3 sequence
ATGYRSTDRLTEPAWVNY

SEQ ID NO: 3468 - protein, 18 aa, Artificial
  CDR3 sequence
ATGYRSTDRLSDPNWVNY

SEQ ID NO: 3469 - protein, 18 aa, Artificial
  CDR3 sequence
ASGYRSTDRLSDAAWINY

SEQ ID NO: 3470 - protein, 18 aa, Artificial
  CDR3 sequence
ASGYRSTDRLSTPEWINY

SEQ ID NO: 3471 - protein, 18 aa, Artificial
  CDR3 sequence
ASGYRSTDRLSEPGWINY

SEQ ID NO: 3472 - protein, 18 aa, Artificial
  CDR3 sequence
ATGYRSTDRLSTPAWINY

SEQ ID NO: 3473 - protein, 18 aa, Artificial
  CDR3 sequence
ASGYRSTDRLSDPAWTNY

SEQ ID NO: 3474 - protein, 18 aa, Artificial
  CDR3 sequence
ASGYRSPDRLSEPEWINY

SEQ ID NO: 3475 - protein, 18 aa, Artificial
  CDR3 sequence
ASGYRSTDRLSEPGWVNY

SEQ ID NO: 3476 - protein, 18 aa, Artificial
  CDR3 sequence
DRKTLAYYTSRLRSRYDY

SEQ ID NO: 3477 - protein, 18 aa, Artificial
  CDR3 sequence
DRKTLTYYTSRLRSRYDY

SEQ ID NO: 3478 - protein, 18 aa, Artificial
  CDR3 sequence
DRKTLTFYTSRLRSRYDY

SEQ ID NO: 3479 - protein, 18 aa, Artificial
  CDR3 sequence
DRKTLTFYTSRLRSRYDY

SEQ ID NO: 3480 - protein, 18 aa, Artificial
  CDR3 sequence
DRKTLTYYTSRLRSRYEY

SEQ ID NO: 3481 - protein, 18 aa, Artificial
  CDR3 sequence
DGKTLTFYTSRLRSRYDY

SEQ ID NO: 3482 - protein, 18 aa, Artificial
  CDR3 sequence
DQKTLTFYTSRLRSRYDY

SEQ ID NO: 3483 - protein, 18 aa, Artificial
  CDR3 sequence
DRKTLTFYTSRLRSRYDY

SEQ ID NO: 3484 - protein, 18 aa, Artificial
  CDR3 sequence
DQKTLTYYTSRLRSRYDY

SEQ ID NO: 3485 - protein, 18 aa, Artificial
  CDR3 sequence
DGKTLTYYTSRLRSQYDY

SEQ ID NO: 3486 - protein, 18 aa, Artificial
  CDR3 sequence
DRKTLTFYTSRLRSRYDY

SEQ ID NO: 3487 - protein, 14 aa, Artificial
  CDR3 sequence
HASYDRMIYSEYKY

SEQ ID NO: 3488 - protein, 14 aa, Artificial
  CDR3 sequence
HANYDRMINSEYKY

SEQ ID NO: 3489 - protein, 14 aa, Artificial
  CDR3 sequence
HANYDRMINSEYKY

SEQ ID NO: 3490 - protein, 14 aa, Artificial
  CDR3 sequence
HASYDRMINSEYKY

SEQ ID NO: 3491 - protein, 14 aa, Artificial
  CDR3 sequence
HANYDRMINSEYKY

SEQ ID NO: 3492 - protein, 14 aa, Artificial
  CDR3 sequence
HASYDRMINSEYKY

SEQ ID NO: 3493 - protein, 14 aa, Artificial
  CDR3 sequence
HASYDRMIYSEYKY

SEQ ID NO: 3494 - protein, 15 aa, Artificial
  CDR3 sequence
DPRADLVATMTSIRY

SEQ ID NO: 3495 - protein, 15 aa, Artificial
  CDR3 sequence
DPRADLVATMTSIRY

SEQ ID NO: 3496 - protein, 15 aa, Artificial
  CDR3 sequence
DPRADLVATMTSIRY

SEQ ID NO: 3497 - protein, 15 aa, Artificial
  CDR3 sequence
MSKPRNLWRTDSYDY

SEQ ID NO: 3498 - protein, 15 aa, Artificial
  CDR3 sequence
MSKPYNLWRTDSYDY

SEQ ID NO: 3499 - protein, 13 aa, Artificial
  CDR3 sequence
ARDPDLYTGQYEY

SEQ ID NO: 3500 - protein, 13 aa, Artificial
  CDR3 sequence
GEGSANWGLDFGS

SEQ ID NO: 3501 - protein, 11 aa, Artificial
  Framework sequence
WGQGTQVTVSS

SEQ ID NO: 3502 - protein, 11 aa, Artificial
  Framework sequence
WGQGTQVTVSS

SEQ ID NO: 3503 - protein, 11 aa, Artificial
  Framework sequence
WGQGTQVTVSS

SEQ ID NO: 3504 - protein, 11 aa, Artificial
  Framework sequence
WGQGTQVTVSS

SEQ ID NO: 3505 - protein, 11 aa, Artificial
  Framework sequence
WGQGTQVTVSS

SEQ ID NO: 3506 - protein, 11 aa, Artificial
  Framework sequence
WGQGTQVTVSS

SEQ ID NO: 3507 - protein, 11 aa, Artificial
  Framework sequence
WGQGTQVTVSS

SEQ ID NO: 3508 - protein, 11 aa, Artificial
  Framework sequence
WGQGTQVTVSS

SEQ ID NO: 3509 - protein, 11 aa, Artificial
  Framework sequence
WGQGTQVTVSS

SEQ ID NO: 3510 - protein, 11 aa, Artificial
  Framework sequence
WGQGTQVTVSS

SEQ ID NO: 3511 - protein, 11 aa, Artificial
  Framework sequence
WGQGTQVTVSS

SEQ ID NO: 3512 - protein, 11 aa, Artificial
  Framework sequence
WGQGTQVTVSS

SEQ ID NO: 3513 - protein, 11 aa, Artificial
  Framework sequence
WGQGTQVTVSS

SEQ ID NO: 3514 - protein, 11 aa, Artificial
  Framework sequence
WGQGTQVTVSS

SEQ ID NO: 3515 - protein, 11 aa, Artificial
  Framework sequence
WGQGTQVTVSS

SEQ ID NO: 3516 - protein, 11 aa, Artificial
  Framework sequence
WGQGTQVTVSS

SEQ ID NO: 3517 - protein, 11 aa, Artificial
  Framework sequence
WGQGTQVTVSS

SEQ ID NO: 3518 - protein, 11 aa, Artificial
  Framework sequence
WGQGTQVTVSS

SEQ ID NO: 3519 - protein, 11 aa, Artificial
  Framework sequence
WGQGTQVTVSS

SEQ ID NO: 3520 - protein, 11 aa, Artificial
  Framework sequence
WGQGTQVTVSS

SEQ ID NO: 3521 - protein, 11 aa, Artificial
  Framework sequence
WGQGTQVTVSS

SEQ ID NO: 3522 - protein, 11 aa, Artificial
  Framework sequence
WGQGTQVIVSS

SEQ ID NO: 3523 - protein, 11 aa, Artificial
  Framework sequence
WGQGTQVTVSS

SEQ ID NO: 3524 - protein, 11 aa, Artificial
  Framework sequence
WGQGTQVTVSS

SEQ ID NO: 3525 - protein, 11 aa, Artificial
  Framework sequence
WGQGTQVTVSG

SEQ ID NO: 3526 - protein, 11 aa, Artificial
  Framework sequence
WGQGTQVTVSS

SEQ ID NO: 3527 - protein, 11 aa, Artificial
  Framework sequence
WGQGTQVTVSS

SEQ ID NO: 3528 - protein, 11 aa, Artificial
  Framework sequence
WGQGTQVTVSS

SEQ ID NO: 3529 - protein, 11 aa, Artificial
  Framework sequence
WGQGTQVTVSS

SEQ ID NO: 3530 - protein, 11 aa, Artificial
  Framework sequence
WGQGTQVTVSS

SEQ ID NO: 3531 - protein, 11 aa, Artificial
  Framework sequence
WGQGTQVTVSS

SEQ ID NO: 3532 - protein, 11 aa, Artificial
  Framework sequence
WGQGTQVTVSS

SEQ ID NO: 3533 - protein, 11 aa, Artificial
  Framework sequence
WGQGTQVTVSS

SEQ ID NO: 3534 - protein, 11 aa, Artificial
  Framework sequence
WGQGTQVTVSS

SEQ ID NO: 3535 - protein, 11 aa, Artificial
  Framework sequence
WGQGTQVTVSS

SEQ ID NO: 3536 - protein, 11 aa, Artificial
  Framework sequence
WGQGTQVTVSS

SEQ ID NO: 3537 - protein, 11 aa, Artificial
  Framework sequence
WGQGTQVTVSS

SEQ ID NO: 3538 - protein, 11 aa, Artificial
  Framework sequence
WGQGTQVTVSS

SEQ ID NO: 3539 - protein, 11 aa, Artificial
  Framework sequence
WGQGTQVTVSS

SEQ ID NO: 3540 - protein, 11 aa, Artificial
  Framework sequence
WGQGTQVTVSS

SEQ ID NO: 3541 - protein, 11 aa, Artificial
  Framework sequence
WGQGTQVTVSS

SEQ ID NO: 3542 - protein, 11 aa, Artificial
  Framework sequence
WGQGTQVTVSS

SEQ ID NO: 3543 - protein, 11 aa, Artificial
  Framework sequence
WGQGTQVTVSS

SEQ ID NO: 3544 - protein, 11 aa, Artificial
  Framework sequence
WGQGTQVTVSS

SEQ ID NO: 3545 - protein, 11 aa, Artificial
  Framework sequence
WGQGTQVTVSS

SEQ ID NO: 3546 - protein, 11 aa, Artificial
  Framework sequence
WGQGTQVTVSS

SEQ ID NO: 3547 - protein, 11 aa, Artificial
  Framework sequence
WGQGTQVTVSS

SEQ ID NO: 3548 - protein, 11 aa, Artificial
  Framework sequence
WGQGTQVTVSS

SEQ ID NO: 3549 - protein, 11 aa, Artificial
  Framework sequence
WGQGTQVTVSS

SEQ ID NO: 3550 - protein, 11 aa, Artificial
  Framework sequence
WGQGTQVTVSS

SEQ ID NO: 3551 - protein, 11 aa, Artificial
  Framework sequence
WGQGTQVTVSS

SEQ ID NO: 3552 - protein, 11 aa, Artificial
  Framework sequence
WGQGTQVTVSS

SEQ ID NO: 3553 - protein, 11 aa, Artificial
  Framework sequence
WGQGTQVTVSS

SEQ ID NO: 3554 - protein, 11 aa, Artificial
  Framework sequence
WGQGTQVTVSS

SEQ ID NO: 3555 - protein, 11 aa, Artificial
  Framework sequence
WGQGTQVTVSS

SEQ ID NO: 3556 - protein, 11 aa, Artificial
  Framework sequence
WGQGTQVTVSS

SEQ ID NO: 3557 - protein, 11 aa, Artificial
  Framework sequence
WGQGTQVTVSS

SEQ ID NO: 3558 - protein, 11 aa, Artificial
  Framework sequence
WGQGTQVTVSS

SEQ ID NO: 3559 - protein, 11 aa, Artificial
  Framework sequence
WGQGTQVTVSS

SEQ ID NO: 3560 - protein, 11 aa, Artificial
  Framework sequence
WGQGTQVTVSS

SEQ ID NO: 3561 - protein, 11 aa, Artificial
  Framework sequence
WGQGTQVTVSS

SEQ ID NO: 3562 - protein, 11 aa, Artificial
  Framework sequence
WGQGTQVTVSS

SEQ ID NO: 3563 - protein, 11 aa, Artificial
  Framework sequence
WGQGTQVTVSS

SEQ ID NO: 3564 - protein, 11 aa, Artificial
  Framework sequence
WGQGTQVTVSS

SEQ ID NO: 3565 - protein, 11 aa, Artificial
  Framework sequence
WGQGTQVTVSS

SEQ ID NO: 3566 - protein, 499 aa, Artificial
  Nanobody sequence
EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGGSGGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3567 - protein, 508 aa, Artificial
  Nanobody sequence
EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGGSGGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3568 - protein, 546 aa, Artificial [sequence omitted]

SEQ ID NO: 3569 - protein, 484 aa, Artificial
  Nanobody sequence
EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSS

SEQ ID NO: 3570 - protein, 493 aa, Artificial
  Nanobody sequence
EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSS

SEQ ID NO: 3571 - protein, 531 aa, Artificial
  Nanobody sequence
EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSS

SEQ ID NO: 3572 - protein, 493 aa, Artificial
  Nanobody sequence
EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSS

SEQ ID NO: 3573 - protein, 502 aa, Artificial
  Nanobody sequence
EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSS

SEQ ID NO: 3574 - protein, 540 aa, Artificial
  Nanobody sequence
EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSEVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSS

SEQ ID NO: 3575 - protein, 484 aa, Artificial
  Nanobody sequence
EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKEVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSS

SEQ ID NO: 3576 - protein, 493 aa, Artificial
  Nanobody sequence
EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKEVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSS

SEQ ID NO: 3577 - protein, 531 aa, Artificial
  Nanobody sequence
EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKEVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSS

SEQ ID NO: 3578 - protein, 493 aa, Artificial
  Nanobody sequence
EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSEVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSS

SEQ ID NO: 3579 - protein, 502 aa, Artificial
  Nanobody sequence
EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSGGGGSGGGSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSEVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSS

SEQ ID NO: 3580 - protein, 540 aa, Artificial
  Nanobody sequence
EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSSELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSEVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSS

SEQ ID NO: 3581 - protein, 499 aa, Artificial; identical to SEQ ID NO: 3566
  Nanobody sequence

SEQ ID NO: 3582 - protein, 484 aa, Artificial; identical to SEQ ID NO: 3569
  Nanobody sequence

SEQ ID NO: 3583 - DNA, 1500 bp, Artificial
  Nanobody sequence
gaagtacaactagttgagtctgggggtggtcttgtgcaggccgggggtagcttgtccatttcatgtgcagcgagtggagggagcctgtcgaactacgttctgggttggttcagacaagctcctgggaaggaaagagaatttgtcgctgcaattaactggagaggtgatataactattggccctccaaatgtggaaggccggtttactatttccagggacaatgctaaaaacacgggttatctccagatgaactccttggctccggacgacactgccgtgtactattgtggagccggtacccccctcaaccccggcgcgtacatatacgactggtcttacgactattggggacggggcacgcaggtaaccgttagcagcggaggcgggggatcgggaggcggtgggagcggtggtggcgggtcagaggtacaactagtggagagtggtggaggtctcgtccaagctgggggttcattgtctatttcgtgtgctgccagcggaggatcgctcagtaattacgtgttaggctggtttcgccaagcacctgggaaagaacgagagttcgtcgctgcaatcaactggcgaggggacataaccataggtccacctaatgttgagggtaggttcacaatctctcgggacaatgcgaagaacacaggatatcttcagatgaatagtcttgccccagacgatacggctgtttattattgcggtgcagggacccccctgaatccgggggcctacatttatgattggtcatacgattattggggacgtgggacccaagttactgtgtcttcggaaccaaagtcgtgcgataagacccatacctgtccgccctgtcctgctccggaacttctaggcggcccctctgtgtttcttttcccacccaagccgaaggatacgcttatgatttctcgcaccccagaagtgacgtgtgttgtcgtcgacgttagtcatgaagacccagaggtcaaatttaattggtacgtcgacggggtcgaagtccacaatgcgaaaactaaacctagggaggagcaatacaactcgacatatcgtgtagtcagcgtcctgactgtcttacatcaggactggctcaacggtaaagaatataaatgtaaggtctctaacaaagctttgcctgcgccgattgaaaagaccatatctaaagcgaagggacaaccaagagaaccacaagtgtatacgttaccgccgtcacgagacgaactgacaaagaaccaggtctctctcacctgcctggtcaaggggttttaccctagcgacattgccgtcgagtgggaatccaacggacagcccgaaaataactacaagacaactcccccggttttagattcggacgggagtttttttctgtatagtaaacttacggttgataagtcgcgctggcagcaaggcaacgtcttctcttgttctgtgatgcatgaggcgctccacaatcactatacccaaaaatcgctctccttgtcgccaggcaaatga

SEQ ID NO: 3584 - protein, 433 aa, Artificial
  Nanobody sequence
EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQPGGSLRLSCAASGLTLDYYALGWFRQAPGKEREGVSCISSSDHTTTYTDSVKGRFTISWDNAKNTLYLQMNSLKPEDTAVYYCAADPALGCYSGSYYPRYDFWGQGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSAAAEQKLISEEDLNGAAHHHHHH

SEQ ID NO: 3585 - protein, 421 aa, Artificial
  Nanobody sequence
EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGSEVQLVESGGGLVQPGGSLRLSCAASGLTLDYYALGWFRQAPGKEREGVSCISSSDHTTTYTDSVKGRFTISWDNAKNTLYLQMNSLKPEDTAVYYCAADPALGCYSGSYYPRYDFWGQGTQVTVSSGGGGSGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSAAAEQKLISEEDLNGAAHHHHHH

SEQ ID NO: 3586 - protein, 432 aa, Artificial
  Nanobody sequence
EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQPGGSLRVSCAASGFTFNDYIMGWFRQAPGKERMFIAAISGTGTIKYYGDLVRGRFTISRDNAKNTVYLRIDSLNPEDTAVYYCAARQDYGLGYRESHEYDYWGQGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSAAAEQKLISEEDLNGAAHHHHHH

SEQ ID NO: 3587 - protein, 420 aa, Artificial
  Nanobody sequence
EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGSEVQLVESGGGLVQPGGSLRVSCAASGFTFNDYIMGWFRQAPGKERMFIAAISGTGTIKYYGDLVRGRFTISRDNAKNTVYLRIDSLNPEDTAVYYCAARQDYGLGYRESHEYDYWGQGTQVTVSSGGGGSGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSAAAEQKLISEEDLNGAAHHHHHH

SEQ ID NO: 3588 - protein, 410 aa, Artificial
  Nanobody sequence
EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQPGGSLRLSCAASGLTLDYYALGWFRQAPGKEREGVSCISSSDHTTTYTDSVKGRFTISWDNAKNTLYLQMNSLKPEDTAVYYCAADPALGCYSGSYYPRYDFWGQGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSS

SEQ ID NO: 3589 - protein, 398 aa, Artificial
  Nanobody sequence
EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGSEVQLVESGGGLVQPGGSLRLSCAASGLTLDYYALGWFRQAPGKEREGVSCISSSDHTTTYTDSVKGRFTISWDNAKNTLYLQMNSLKPEDTAVYYCAADPALGCYSGSYYPRYDFWGQGTQVTVSSGGGGSGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSS

SEQ ID NO: 3590 - protein, 409 aa, Artificial
  Nanobody sequence
EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGGSGGGGSEVQLVESGGGLVQPGGSLRVSCAASGFTFNDYIMGWFRQAPGKERMFIAAISGTGTIKYYGDLVRGRFTISRDNAKNTVYLRIDSLNPEDTAVYYCAARQDYGLGYRESHEYDYWGQGTQVTVSSGGGGSGGGGSGGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSS

SEQ ID NO: 3591 - protein, 397 aa, Artificial
  Nanobody sequence
EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSSGGGGSGGGSEVQLVESGGGLVQPGGSLRVSCAASGFTFNDYIMGWFRQAPGKERMFIAAISGTGTIKYYGDLVRGRFTISRDNAKNTVYLRIDSLNPEDTAVYYCAARQDYGLGYRESHEYDYWGQGTQVTVSSGGGGSGGGSEVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSS

The invention claimed is:

1. A polypeptide comprising an amino acid sequence with the general structure FR1-CDR1-FR2-CDR2-FR3-CDR3-FR4 in which FR1-FR4 refer to framework regions 1 to 4, respectively, and in which CDR1 to CDR3 refer to the complementary determining regions 1 to 3 respectively that specifically binds to an F protein of a respiratory syncytial virus (RSV), wherein the polypeptide comprises a combination of CDR1, CDR2, and CDR3 selected from (a), (b), (c), (d), (e), or (f):

(a) a CDR1 comprising an amino acid selected from the group consisting of:
1. the amino acid sequence of SEQ ID NO: 723;
2. amino acid sequences that have at least 80% amino acid identity with the amino acid sequence of SEQ ID NO: 723; and
3. amino acid sequences that have 3, 2, or 1 amino acid difference with the amino acid sequence of SEQ ID NO: 723;

a CDR2 comprising an amino acid selected from the group consisting of:
1. the amino acid sequence of SEQ ID NO: 1287;
2. amino acid sequences that have at least 80% amino acid identity with the amino acid sequence of SEQ ID NO: 1287; and
3. amino acid sequences that have 3, 2, or 1 amino acid difference with the amino acid sequence of SEQ ID NO: 1287;

a CDR3 comprising an amino acid selected from the group consisting of:
1. the amino acid sequence of SEQ ID NO: 1851;
2. amino acid sequences that have at least 80% amino acid identity with the amino acid sequence of SEQ ID NO: 1851; and
3. amino acid sequences that have 3, 2, or 1 amino acid difference with the amino acid sequence of SEQ ID NO: 1851;

(b) a CDR1 comprising an amino acid selected from the group consisting of:
1. the amino acid sequence of SEQ ID NO:731;
2. amino acid sequences that have at least 80% amino acid identity with the amino acid sequence of SEQ ID NO: 731; and
3. amino acid sequences that have 3, 2, or 1 amino acid difference the amino acid sequence of SEQ ID NO: 731;

a CDR2 comprising an amino acid selected from the group consisting of:
1. the amino acid sequence of SEQ ID NO: 1295;
2. amino acid sequences that have at least 80% amino acid identity with the amino acid sequence of SEQ ID NO: 1295; and
3. amino acid sequences that have 3, 2, or 1 amino acid difference the amino acid sequence of SEQ ID NO: 1295;

a CDR3 comprising an amino acid selected from the group consisting of:

1. the amino acid sequence of SEQ ID NO: 1859;
2. amino acid sequences that have at least 80% amino acid identity with the amino acid sequence of SEQ ID NO: 1859; and
3. amino acid sequences that have 3, 2, or 1 amino acid difference with the amino acid sequence of SEQ ID NO: 1859;

(c) a CDR1 comprising an amino acid selected from the group consisting of:

1. the amino acid sequence of SEQ ID NO: 918;
2. amino acid sequences that have at least 80% amino acid identity with the amino acid sequence of SEQ ID NO: 918; and
3. amino acid sequences that have 3, 2, or 1 amino acid difference with the amino acid sequence of SEQ ID NO: 918;

a CDR2 comprising an amino acid selected from the group consisting of:

1. the amino acid sequence of SEQ ID NO: 1482;
2. amino acid sequences that have at least 80% amino acid identity with the amino acid sequence of SEQ ID NO: 1482; and
3. amino acid sequences that have 3, 2, or 1 amino acid difference with the amino acid sequence of SEQ ID NO: 1482;

a CDR3 comprising an amino acid selected from the group consisting of:

1. the amino acid sequence of SEQ ID NO: 2046;
2. amino acid sequences that have at least 80% amino acid identity the amino acid sequence of SEQ ID NO: 2046; and
3. amino acid sequences that have 3, 2, or 1 amino acid difference with the amino acid sequence of SEQ ID NO: 2046;

(d) a CDR1 comprising an amino acid selected from the group consisting of:

1. the amino acid sequence of SEQ ID NO: 935;
2. amino acid sequences that have at least 80% amino acid identity the amino acid sequence of SEQ ID NO: 935; and
3. amino acid sequences that have 3, 2, or 1 amino acid difference with the amino acid sequence of SEQ ID NO: 935;

a CDR2 comprising an amino acid selected from the group consisting of:

1. the amino acid sequence of SEQ ID NO: 1499;
2. amino acid sequences that have at least 80% amino acid identity with the amino acid sequence of SEQ ID NO: 1499; and
3. amino acid sequences that have 3, 2, or 1 amino acid difference with the amino acid sequence of SEQ ID NO: 1499;

a CDR3 comprising an amino acid selected from the group consisting of:

1. the amino acid sequence of SEQ ID NO: 2063;
2. amino acid sequences that have at least 80% amino acid identity with the amino acid sequence of SEQ ID NO: 2063; and
3. amino acid sequences that have 3, 2, or 1 amino acid difference with the amino acid sequence of SEQ ID NO: 2063;

(e) a CDR1 comprising an amino acid selected from the group consisting of:

1. the amino acid sequence of SEQ ID NO: 936;
2. amino acid sequences that have at least 80% amino acid identity with the amino acid sequence of SEQ ID NO: 936; and
3. amino acid sequences that have 3, 2, or 1 amino acid difference the amino acid sequences of SEQ ID NO: 936;

a CDR2 comprising an amino acid selected from the group consisting of:

1. the amino acid sequence of SEQ ID NO: 1500;
2. amino acid sequences that have at least 80% amino acid identity with the amino acid sequence of SEQ ID NO: 1500; and
3. amino acid sequences that have 3, 2, or 1 amino acid difference with the amino acid sequence of SEQ ID NO: 1500;

a CDR3 comprising an amino acid selected from the group consisting of:

1. the amino acid sequence of SEQ ID NO: 2064;
2. amino acid sequences that have at least 80% amino acid identity with the amino acid sequence of SEQ ID NO: 2064; and
3. amino acid sequences that have 3, 2, or 1 amino acid difference with the amino acid sequence of SEQ ID NO: 2064;

(f) a CDR1 comprising an amino acid selected from the group consisting of:

1. the amino acid sequence of SEQ ID NO: 2595;
2. amino acid sequences that have at least 80% amino acid identity with the amino acid sequence of SEQ ID NO: 2595; and
3. amino acid sequences that have 3, 2, or 1 amino acid difference with the amino acid sequence of SEQ ID NO: 2595;

a CDR2 comprising an amino acid selected from the group consisting of:

1. the amino acid sequence of SEQ ID NO: 2611;
2. amino acid sequences that have at least 80% amino acid identity with the amino acid sequence of SEQ ID NO: 2611; and
3. amino acid sequences that have 3, 2, or 1 amino acid difference with the amino acid sequence of SEQ ID NO: 2611;

a CDR3 comprising an amino acid selected from the group consisting of:

1. the amino acid sequence of SEQ ID NO: 2627;
2. amino acid sequences that have at least 80% amino acid identity with the amino acid sequence of SEQ ID NO: 2627; and
3. amino acid sequences that have 3, 2, or 1 amino acid difference the amino acid sequence of SEQ ID NO: 2627.

2. The polypeptide according to claim 1, wherein said amino acid sequence neutralizes RSV.

3. The polypeptide comprising one or more amino acid sequences according to claim 1, and optionally further comprising one or more other groups, residues, moieties or binding units, optionally linked via one or more linkers.

4. The polypeptide according to claim 1, that comprises a domain antibody, a single domain antibody, a $V_{HH}$ sequence, a partially or fully humanized $V_{HH}$ sequence, a camelized $V_H$ sequence, or an immunoglobulin single variable domain.

5. A polypeptide according to claim 1, that comprises one or more amino acid sequences having at least 80% amino acid identity with at least one of the amino acid sequences of SEQ ID NO's: 1 to 22, 126 to 407, 2431 to 2448, 2574 to 2581, 2682 to 2717 and 3064 to 3128 in which for the purposes of determining the degree of amino acid identity, the amino acid residues that form the CDR sequences are disregarded;

and in which:

optionally one or more of the amino acid residues at positions 11, 37, 44, 45, 47, 83, 84, 103, 104 and 108 according to the Kabat numbering are chosen from the Hallmark residues mentioned in Table B-2.

6. A polypeptide according to claim 1, that comprises one or more amino acid sequences selected from SEQ ID NO's: 159, 167, 181, 190, 193, 224, 354, 371, 372, and 2579 or of an amino acid sequence which has at least 80% amino acid identity, at least 90% amino acid identity, 95% amino acid identity, 99% amino acid identity, or 100% amino acid identity with the at least one of the amino acid sequences of SEQ ID NO's: 159, 167, 181, 190, 193, 224, 354, 371, 372, and 2579.

7. The polypeptide according to claim 1, comprising one or more amino acid sequences that comprise a partially or fully humanized $V_{HH}$ sequence.

8. The polypeptide according to claim 1, further comprising one or more other groups, residues, moieties or binding units selected from the group consisting of a domain antibody, a single domain antibody, a $V_{HH}$ sequence, a partially or fully humanized $V_{HH}$ sequence, a camelized $V_H$ sequence, or an immunoglobulin single variable domain.

9. The polypeptide according to claim 1, wherein the polypeptide comprises at least one amino acid sequence directed against a first antigenic determinant, epitope, part or domain of an F protein of RSV virus and at least one amino acid sequence directed against a second antigenic determinant, epitope, part or domain of the F protein of RSV virus different from the first antigenic determinant, epitope, part or domain.

10. The polypeptide according to claim 1, wherein the polypeptide comprises three amino acid sequences that bind the same antigenic determinant, epitope, part or domain of the F protein.

11. The polypeptide according to claim 1, wherein the polypeptide comprises two amino acid sequences that bind a first antigenic determinant, epitope, part or domain of the F protein and one amino acid sequence that binds a second antigenic determinant, epitope, part or domain of the F protein.

12. A polypeptide according to claim 1 that comprises an amino acid sequence from the group consisting of SEQ ID NO's: 2408 to 2413, 2415, 2989 to 2994, 2996 to 2998, 3049 and 3584 to 3587 or from the group consisting of from amino acid sequences that have more than 80%, more than 90%, more than 95%, or 99% or more sequence identity with at least one of the amino acid sequences of SEQ ID NO's: 2408 to 2413, 2415, 2989 to 2994, 2996 to 2998, 3049 and 3584 to 3587.

13. A composition comprising at least one polypeptide according to claim 1.

14. A composition according to claim 13, further comprising at least one pharmaceutically acceptable carrier, diluent or excipient and/or adjuvant, and that optionally comprises one or more further pharmaceutically active polypeptides and/or compounds.

15. A pharmaceutical composition comprising a polypeptide according to claim 1 and a carrier suitable for pulmonary delivery.

16. A pharmaceutical device comprising an inhaler for liquids, an aerosol or a dry powder inhaler comprising the polypeptide according to claim 1.

17. The polypeptide according to claim 1, comprising:

(a) a CDR1 comprising the amino acid sequence of SEQ ID NO: 723,
a CDR2 comprising the amino acid sequence of SEQ ID NO: 1287; and
a CDR3 comprising the amino acid sequence of SEQ ID NO: 1851;

(b) a CDR1 comprising the amino acid sequence of SEQ ID NO: 731,
a CDR2 comprising the amino acid sequence of SEQ ID NO: 1295; and
a CDR3 comprising the amino acid sequence of SEQ ID NO: 1859;

(c) a CDR1 comprising the amino acid sequence of SEQ ID NO: 918,
a CDR2 comprising the amino acid sequence of SEQ ID NO: 1482; and
a CDR3 comprising the amino acid sequence of SEQ ID NO: 2046;

(d) a CDR1 comprising the amino acid sequence of SEQ ID NO: 935,
a CDR2 comprising the amino acid sequence of SEQ ID NO: 1499; and
a CDR3 comprising the amino acid sequence of SEQ ID NO: 2063;

(e) a CDR1 comprising the amino acid sequence of SEQ ID NO: 936,
a CDR2 comprising the amino acid sequence of SEQ ID NO: 1500; and
a CDR3 comprising the amino acid sequence of SEQ ID NO: 2064;

or (f) a CDR1 comprising the amino acid sequence of SEQ ID NO: 2595,
a CDR2 comprising the amino acid sequence of SEQ ID NO: 2611; and
a CDR3 comprising the amino acid sequence of SEQ ID NO: 2627.

18. The polypeptide of claim 4, wherein the immunoglobulin single variable domain has been obtained by affinity maturation.

19. The polypeptide of claim 8, wherein the immunoglobulin single variable domain has been obtained by affinity maturation.

* * * * *